United States Patent 11,602,557 (BUNYAVIRALES VACCINE) - sequence listing, part 7

SEQ ID NO: 9303 - RNA, 4329 nt, Artificial Sequence
  derived and/or modified CDS sequence (opt4) from CHATV(Mohko M07-1)__KF719225.1__GP
augaugaucuucauccugauccuguucgccgugagcgccgccagccccguguaccagagaugcuuccaggacggcgccaucgugaagcagaaccccagcaaggaggccgugaccgaggugugccugaaggacgacgugagcaugaucaagaccgaggccagauacgugaagaacgccaccggcaucuacagcaacaacguggccaucagaaaguggcuggugagcgacuggcacgacugcagacccagaaaggugagcggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucgugcugcugagcauccugagcaagaccuacaucugcuaccugcugaugcccaucuucauccccaucgccuacauguacggcaucaucuacaacaagagcugcaagaagugcaagcugugcggccugguguaccaccccuucaccgagugcggcacccacugcgugugcggcgccagauacgacaccagcgacagaaugaagcugcacagaagcagcggccugugccccggcuacaagagccugagagccgccagagugaugugcaagagcaagggccccgccagcauccugagcaucaucaccgccauccuggugcugaccuucgugacccccaucaacagcauggugaucggcgagagcaaggagguguucgagcuggaggagcugcccgacgacaugcuggagauggcccugaagaucaaccuguacuacuucgugugcgugaucaacuacgccgugaccuggagccugaucaucguggcccugcugaucgcccugaucuucaagaaguaccagcacagauuccugaaccuguacgccauguacugcgaggagugcgacauguaccacgacagaaucggccugaagagaaacggcgacuucaccaacaagugcagacagugcaccugcggccaguacgaggacgccaccggccugaugacccacagaaagaccuacaacugccuggugcaguacaagagcaaguggauccugaacuuccugaucaccuacauggugcugacccugaucaaggacagcgccaucaucgugcaggccgccggcaccgacuucagcgccugccuggaggcccagagcguggacuggaacugcaccggccccuuccugaaccugggcaacugccagaagcagcagaagaaggagagcuacgccaacaucgccacccagcugaagggccugcaggccaucagcgugcuggacgugcccaugaucgccaacauccccgaggacaucgccggcgcccugagauacaucgaggagaaggacaccuuccacgugcagcugaccgccgaguacgccaugcugaccagauacugcgacuacuacacccaguucgccgacaacagcggcuacagccagaccaccuggagaguguaccugagaagccacgacuucgacgccugcauccuguaccccaaccagcacuucugcagaugcgugaagcacggcgacaagugcggcagcagcaacagagacuucgccaacgagaugaagaacuacuacagcggcaagcagaacaaguucgacaaggaccugaaccuggcccugauggccgugcaccacgccuucagaggcaccagcagcgccuacaucgccaccaugcugagcaagaagagcaacaacgaccuggugaccuacaccaacaagaucaaggagaaguuccccggcaacgcccugcugaaggccaucauggacuacaucagcuacaugaagggccugagcgagaugaccaacuucaaguacgacgaguucugggacgaccugcugcacaagcccagccccaccaacgcccccccccugagcagagacagcgagcccagcuacaacuucaagagcgugaucagcagcagaagcgugaagagcugcaagaacgugaagaacguggugugccugagccccagaagcggcgugagcuacgacagcauccuggccugcggcgagcccaacggccccagcguguacaagaagcccagcgacggcaucuuccagagcaacagcgacaagaccauguacugccuggccgacagccacugccuggaggacuucgagguggugagccaggaggagcuggacgccaucaagaagagcaagugcugggugaccgaguaccccaacgugaagcugagcaagcugagcgacggcaucaccagcugcagaaugaaggacagcggcaagugcaacguggccgccaacagauggcccaucauccagugcgagaacgacaaguucuacuacagcgagcugcagaacgacuacgacaagacccaggacaucggccacuucugccugagccccggcugcagcaccaucagauuccccaucaaccagaagcacaucagcaacugcaacuggcaggugagcagaagcagcaucgccaagaucgacgugcacgacaucgaggacaucgaccaguacagaaaggccaucacccagaagcugcagaccggccugagccuguucaaguacgccaagaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaacagcaaggagggcaagcaccugcuggacaucgugggcuacgugaagagcgccagcuacagcagcguguacaccaagcuguacagcaccggccccaccagcggcaucaacaccaagcacgacgagcugugcaccggccccugccccgugaacaucaaccaccagaccggcuggcugaccuucgccaaggagagaaccagcagcuggggcugcgaggaguucggcugccuggccaucagcgacggcugcguguucggcagcugccaggacaucgugagagacgagcugagcguguacagaaaggagaccgaggaggugaccgacguggagcugugccugaccuucagcgacaagaccuacugcaccaaccugaaccccaucacccccaucaucaccgaccuguucgaggugcaguucaagaccguggagaccuacagccugcccagaaucguggccauccagaaccacgaggugaagaucggccagaucaacgaccugggcguguacagcaagggcugcggcaacgugcagaaggugaacggcaccguguacggcaacggcgugcccaaguucgacuaccugugccaccuggccagcagaaaggaggugaucgugagaaagugcuucgacaacgacuaccaggccugcaaguuccugcagacccccgccagcuacagacuggaggagaacagcggcaccgugaccgugaucgacuacaagaagauccugggcaccaucaagaugaaggccauccugggcgacgugaaguacaagaccuucgccgacaacguggacaugaccgccgagggcagcugcgccggcugcaucaacugcuucgagaacauccacugcgagcugacccugcacaccaccaucgacgccagcugccccgugaccagccccugcaccguguuccacgacagaauccugaucacccccaacgagcacaaguacgccaugaaggugaucugcaccgagaagcccggcaacacccugaccaucaagaucugcggcaccaagaucgacgccagccuggcccugaucgacgccaagcccauccuggagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucugcaugaucgugcugcugaucgugaucuacaucgugcugcccaucugcuucaagcugagagacacccugagacagcacgaggacgccuacaagagagagaugaagaucagauga

SEQ ID NO: 9304 - RNA, 4329 nt, Artificial Sequence
  derived and/or modified CDS sequence (opt4) from CHATV(Mohko M07-2-83)__KF719228.1__GP
augaugaucuucauccugauccuguucgccgugagcgccgccagccccguguaccagagaugcuuccaggacggcgccaucgugaagcagaaccccagcaaggaggccgugaccgaggugugccugaaggacgacgugagcaugaucaagaccgaggccagauacgugaagaacgccaccggcaucuacagcaacaacguggccaucagaaaguggcuggugagcgacuggcacgacugcagacccagaaaggugagcggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucgugcugcugagcauccugagcaagaccuacaucugcuaccugcugaugcccaucuucauccccaucgccuacauguacggcaucaucuacaacaagagcugcaagaagugcaagcugugcggccugguguaccaccccuucaccgagugcggcacccacugcgugugcggcgccagauacgacaccagcgacagaaugaagcugcacagaagcagcggccugugccccggcuacaagagccugagagccgccagagugaugugcaagagcaagggccccgccagcauccugagcaucaucaccgccauccuggugcugaccuucgugacccccaucaacagcauggugaucggcgagagcaaggagguguucgagcuggaggagcugcccgacgacaugcuggagauggcccugaagaucaaccuguacuacuucgugugcgugaucaacuacgccgugaccuggagccugaucaucguggcccugcugaucgcccugaucuucaagaaguaccagcacagauuccugaaccuguacgccauguacugcgaggagugcgacauguaccacgacagaaucggccugaagagaaacggcgacuucaccaacaagugcagacagugcaccugcggccaguacgaggacgccaccggccugaugacccacagaaagaccuacaacugccuggugcaguacaagagcaaguggauccugaacuuccugaucaccuacauggugcugacccugaucaaggacagcgccaucaucgugcaggccgccggcaccgacuucagcgccugccuggaggcccagagcguggacuggaacugcaccggccccuuccugaaccugggcaacugccagaagcagcagaagaaggagagcuacgccaacaucgccacccagcugaagggccugcaggccaucagcgugcuggacgugcccaugaucgccaacauccccgaggacaucgccggcgcccugagauacaucgaggagaaggacaccuuccacgugcagcugaccgccgaguacgccaugcugaccagauacugcgacuacuacacccaguucgccgacaacagcggcuacagccagaccaccuggagaguguaccugagaagccacgacuucgacgccugcauccuguaccccaaccagcacuucugcagaugcgugaagcacggcgacaagugcggcagcagcaacugggacuucgccaacgagaugaagaacuacuacagcggcaagcagaacaaguucgacaaggaccugaaccuggcccugauggccgugcaccacgccuucagaggcaccagcagcgccuacaucgccaccaugcugagcaagaagagcaacaacgaccuggugaccuacaccaacaagaucaaggagaaguuccccggcaacgcccugcugaaggccaucauggacuacaucagcuacaugaagggccugagcgagaugaccaacuucaaguacgacgaguucugggacgaccugcugcacaagcccagccccaccaacgcccccccccugagcagagacagcgagcccagcuacaacuucaagagcgugaucagcagcagaagcgugaagagcugcaagaacgugaagaacguggugugccugagccccagaagcggcgugagcuacgacagcauccuggccugcggcgagcccaacggccccagcguguacaagaagcccagcgacggcaucuuccagagcaacagcgacaagaccauguacugccuggccgacagccacugccuggaggacuucgagguggugagccaggaggagcuggacgccaucaagaagagcaagugcugggugaccgaguaccccaacgugaagcugagcaagcugagcgacggcaucaccagcugcagaaugaaggacagcggcaagugcaacguggccgccaacagauggcccaucauccagugcgagaacgacaaguucuacuacagcgagcugcagaacgacuacgacaagacccaggacaucggccacuucugccugagccccggcugcagcaccaucagauuccccaucaaccagaagcacaucagcaacugcaacuggcaggugagcagaagcagcaucgccaagaucgacgugcacgacaucgaggacaucgaccaguacagaaaggccaucacccagaagcugcagaccggccugagccuguucaaguacgccaagaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaacagcaaggagggcaagcaccugcuggacaucgugggcuacgugaagagcgccagcuacagcagcguguacaccaagcuguacagcaccggccccaccagcggcaucaacaccaagcacgacgagcugugcaccggccccugccccgugaacaucaaccaccagaccggcuggcugaccuucgccaaggagagaaccagcagcuggggcugcgaggaguucggcugccuggccaucagcgacggcugcguguucggcagcugccaggacaucgugagagacgagcugagcguguacagaaaggagaccgaggaggugaccgacguggagcugugccugaccuucagcgacaagaccuacugcaccaaccugaaccccaucacccccaucaucaccgaccuguucgaggugcaguucaagaccguggagaccuacagccugcccagaaucguggccauccagaaccacgaggugaagaucggccagaucaacgaccugggcguguacagcaagggcugcggcaacgugcagaaggugaacggcaccguguacggcaacggcgugcccaaguucgacuaccugugccaccuggccagcagaaaggaggugaucgugagaaagugcuucgacaacgacuaccaggccugcaaguuccugcagacccccgccagcuacagacuggaggagaacagcggcaccgugaccgugaucgacuacaagaagauccugggcaccaucaagaugaaggccauccugggcgacgugaaguacaagaccuucgccgacaacguggacaugaccgccgagggcagcugcgccggcugcaucaacugcuucgagaacauccacugcgagcugacccugcacaccaccaucgacgccagcugccccgugaccagccccugcaccguguuccacgacagaauccugaucacccccaacgagcacaaguacgccaugaaggugaucugcaccgagaagcccggcaacacccugaccaucaagaucugcggcaccaagaucgacgccagccuggcccugaucgacgccaagcccauccuggagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucugcaugaucgugcugcugaucgugaucuacaucgugcugcccaucugcuucaagcugagagacacccugagacagcacgaggacgccuacaagagagagaugaagaucagauga

SEQ ID NO: 9305 - RNA, 4326 nt, Artificial Sequence
  derived and/or modified CDS sequence (opt4) from CHATV(LEIV-15854)__HQ734820.1__GP
augaucuucauccugauccuguucgccgugagcgccgccagccccguguaccagagaugcuuccaggacggcgccaucgugaagcagaaccccagcaaggaggccgugaccgaggugugccugaaggacgacgugagcaugaucaagaccgaggccagauacgugaagaacgccaccggcaucuacagcaacaacguggccaucagaaaguggcuggugagcgacuggcacgacugcagacccagaaaggugagcggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucgugcugcugagcauccugagcaagaccuacaucugcuaccugcugaugcccaucuucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagaagcagcggccugugccccggcuacaagagccugagagccgccagagugaugugcaagagcaagggccccgccagcauccugagcaucaucaccgccauccuggugcugaccuucgugacccccaucaacagcauggugaucggcgagagcaaggagguguucgagcuggaggagcugcccgacgacaugcuggagauggcccugaagaucaaccuguacuacuucgugugcgugaugaacuacgccgugaccuggagccuggugaucguggcccugcugaucgcccugaucuucaagaaguaccagcacagauuccugaaccuguacgccauguacugcgaggagugcgacauguaccacgacagaaucggccugaagagaaacggcgacuucaccaacaagugcagacagugcaccugcggccaguacgaggacgccaccggccugaugacccacagaaagaccuacaacugccuggugcaguacaagagcaaguggauccugaacuuccugaucaccuacauggugcugacccugaucaaggacagcgccaucaucgugcaggccgccggcaccgacuucagcgccugccuggaggcccagagcguggacuggaacugcaccggccccuuccugaaccugggcaacugccagaagcagcagaagaaggagagcuacgccaacaucgccacccagcugaagggccugcaggccaucagcgugcuggacgugcccaugaucgccaacauccccgaggacaucgccggcgcccugagauacaucgaggagaaggacaccuuccacgugcagcugaccgccgaguacgccaugcugaccagauacugcgacuacuacacccaguucgccgacaacagcggcuacagccagaccaccuggagaguguaccugagaagccacgacuucgacgccugcauccuguaccccaaccagcacuucugcagaugcgugaagcacggcgacaagugcagcagcagcaacugggacuucgccaacgagaugaagaacuacuacagcggcaagcagaacaaguucgacaaggaccugaaccuggcccugauggccgugcaccacgccuucagaggcaccagcagcgccuacaucgccaccaugcugagcaagaagcugaacaacgaccugaucaccuacaccaacaagaucaaggagaaguuccccggcaacgcccugcugaaggccaucauggacuacaucagcuacaugaagggccugagcgagaugaccaacuucaaguacgacgaguucugggacgaccugcugcacaagcccagccccaccaacgcccccccccugagcagagacagcgagcccagcuacaacuucaagagcgugaucagcagcagaagcgugaagagcugcaagaacgugaagaacguggugugccugagccccagaagcggcgccagcuacgacagcauccuggccugcggcgagcccaacggccccagcguguacaagaagcccagcgacggcguguuccagagcaacagcgacaagaccauguacugccuggccgacagccacugccuggaggacuucgagguggugagccaggaggagcuggacgccaucaagaagagcaagugcugggugaccgaguaccccaacgugaagcugagcaagcugagcgacggcaucaccagcugcagaaugaaggacagcggcaagugcaacguggccgccaacagauggcccaucauccagugcgagaacgacaaguucuacuacagcgagcugcagaacgacuacgacaagacccaggacaucggccacuucugccugagccccggcugcagcaccaucagauuccccaucaaccagaagcacaucagcaacugcaacuggcaggugagcagaagcagcaucgccaagaucgacgugcacgacaucgaggacaucgaccaguacagaaaggccaucacccagaagcugcagaccggccugagccuguucaaguacgccaagaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaacagcaaggagggcaagcaccugcuggacaucgugggcuacgugaagagcgccagcuacagcagcguguacaccaagcuguacagcaccggccccaccagcggcaucaacaccaagcacgacgagcugugcaccggccccugccccgugaacaucaaccaccagaccggcuggcugaccuucgccaaggagagaaccagcagcuggggcugcgaggaguucggcugccuggccaucagcgacggcugcguguucggcagcugccaggacaucgugagagacgagcugagcguguacagaaaggagaccgaggaggugaccgacguggagcugugccugaccuucagcgacaagaccuacugcaccaaccugaaccccaucacccccaucaucaccgaccuguucgaggugcaguucaagaccguggagaccuacagccugcccagaaucguggccgugcagaaccacgaggugaagaucggccagaucaacgaccugggcaucuacagcaagggcugcggcaacgugcagaaggugaacggcaccguguacggcaacggcgugcccaaguucgacuaccugugccaccuggccagcagaaaggaggugaucgugagaaagugcuucgacaacgacuaccaggccugcaaguuccugcagacccccgccagcuacagacuggaggagaacagcggcaccgugaccgugaucgacuacaagaagauccugggcaccaucaagaugaaggccauccugggcgacgugaaguacaagaccuucgccgacaacguggacaugaccgccgagggcagcugcgccggcugcaucaacugcuucgagaacauccacugcgagcugacccugcacaccaccaucgacgccagcugccccgugaccagccccugcaccguguuccacgacagaauccugaucacccccaacgagcacaaguacgccaugaaggugaucugcaccgagaagcccggcaacacccugaccaucaagaucugcagcaccaagaucgacgccagccuggcccugaucgacgccaagcccauccuggagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucugcgugaucgugcugcugaucgugaucuacaucgugcugcccaucugcuucaagcugagagacacccugagacagcacgaggacgccuacaagagagagaugaagaucagauga

SEQ ID NO: 9306 - RNA, 4326 nt, Artificial Sequence
  derived and/or modified CDS sequence (opt4) from CHATV(LEIV-17756)__EU621834.1__GP
augaucuucauccugauccuguucgccgugagcaccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcaccuucagcaacaacguggccaucagaaaguggaucgugagcgacuggcacgacugcagacccaagaaggugagcggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucgugcugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagaagcagcggccugugccccggcuacaagagccugagagccgccagagugaugugcaagagcaagggccccgccagcauccugagcaucaucaccgccauccuggugcugaccuucgugacccccaucaacagcaugguggugggcgagagcaaggagguguucgagcuggaggagcugcccgacgacaugcuggagauggcccugaagaucaacuucuacuacuucgugugcgugaugaacuacgccgugaccuggggccugaucgugguggcccugcugaucggccugaucuucaagaaguaccagcacagauuccugaaccuguacgccauguacugcgaggagugcgacauguaccacgacagaaccggccugaagagaaacggcgacuucaccaacaagugcagacagugcaccugcggccaguacgaggacgccaccggccugaugacccacagaaagaccuacaacugccuggugcaguacaagagcaaguggauccugaacuuccugaucaccuacauggugcugacccugaucaaggacagcgccaucguggugcaggccaccggcaccgacuucagcagcugccuggagacccagagcgugaacuggaacugcaccggccccuuccugaaccugggcaacugccagaagcagcagaagaaggagagcuacgccaacaucgccacccagcugaagggccugcaggccaucagcgugcuggacaugcccaugaucgccagcauccccgaggacaucgccggcgcccugagauacaucgaggagagagagaccuuccacgugcagcugaccgccgaguacgccaugcugaccagauacugcgacuacuacacccaguucgccgacaacagcggcuacagccagaccaccuggagaguguaccugagaagccacgacuucgacgccugcauccuguaccccaaccagcacuucugcagaugcgugaagcacggcgacaagugcagcagcagcaacugggacuucgccaacgagaugaagaacuacuacagcggcaagcagaacaaguucgacaaggaccugaaccuggcccugaugaccaugcaccacgccuucagaggcaccagcagcgccuacaucgccgcccugcugagcaagagaagcaacgacgaccugguggccuacaccaacaagaucaaggagaaguuccccggcaacgcccugcugaaggccgugauggacuacaucagcuacaugaagagccugagcgagaugagcaacuucaaguacgacgaguucugggacgaccugcugcacaagcccaaccccaccaaggcccccagccugagcagaggcgacgagcccgccuacaacuucaagcuggccaucagcagcagaagcaugaagagcugcaagaacgugaagagcguggugugccugagccccagaagcggcgugagcuacgacagcauccuggccugcggcgagcccaacgcccccagcgugcacagaaagcccagcgacggcguguuccagagcaacagcgacaagaccauguacugccuggccgacagccacugccuggaggacuucgagguggugagccaggaggagcuggacgccaucaagaagagcgagugcugggugaccgaguaccccaacgugaagcugagcaagcugagcgacggcaucaagagcugcagaaugaaggacagcggcaagugcaacguggccaccaacagauggcccaucauccagugcgagaacgacaaguucuacuacagcgagcugcagaacgacuacgacaagacccaggacaucggccacuucugccugagccccggcugcagcaccaucagauuccccaucaaccagaagcacaucagcaacugcaacuggcaggugagcagaagcagcaucgccaagaucgacgugcacaacaucgaggacaucgagcaguacagaaaggccaucacccagaagcugcagaccagccugagccuguucaaguacgccagaaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaacagcaaggagggcaagcaccugcuggacgugaucggcuacgugaagagcgccagcuacagcagcguguacaccaagcuguacagcaccggccccaccagcggcaucaacaccaagcacgacgagcugugcaccggccccugccccgccaacaucaagcaccagaccggcuggcugaccuucgccagagagagaaccagcagcuggggcugcgaggaguucggcugccuggccaucagcgacggcugcguguucggcagcugccaggacaucgugagagacgagcugagcguguacagaaaggagaccgaggaggugaccgacguggagcugugccugaccuucagcgacaagaccuacugcaccaaccugaaccccaucacccccaucaucaccgaccuguucgaggugcaguucaagaccguggagaccuacagccugcccagaaucguggccauccagaaccacgagaucaagaucggccagaucaacgaccugggcguguacagcaagggcugcggcaacgugcagaaggugaacggcaccguguacggcaacggcgugcccaaguucgacuaccugugccaccuggccagcagaaaggaggugaucgugagaaagugcuucgacaacgacuaccaggccugcaaguuccugcagacccccgccagcuacagacuggaggagaacagcggcaccgugaccgugaucgacuacaagaagauccugggcaccaucaagaugaaggccauccugggcgacgugaaguacaagaccuucgccgacaacguggacaucaccgccgagggcagcugcaccggcugcaucaacugcuucgagaacauccacugcgagcugaccauccacaccaccaucgacgccagcugccccgugaccagccccugcaccguguuccacgacagaauccuggugacccccaacgagcacaaguacgccaugaaggugaucugcaccgagaagcccggcagcacccuggccaucaagaucugcaacaccaagaucgacgccagccuggcccugaucgacgccaagcccauccuggagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucgugaucagcaucaucgcccugcugaucgugaucuacaucauccugcccaucugcuucaagcugagagacacccugagaaagcacgaggacgccuacaagagagagaugaagaucagauga

SEQ ID NO: 9307 - RNA, 4326 nt, Artificial Sequence
  derived and/or modified CDS sequence (opt4) from CHATV(LEIV-18733)__HQ734821.1__GP
augaucuucauccuggugcugcuggccgugagcaccgccagccccguguaccagagaugcuuccaggacggcgccaucgugaagcagaaccccagcaaggaggccgugaccgaggugugccugaaggacgacgugagcaugaucaagaccgaggccagauacaugaagaacgccaccggcaccuucagcaacaacguggccaucagaaaguggcuggugagcgacuggcacgacugcagacccaagaaggugagcggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccgugcugcccggcagcaucgccaacagcaucugccagaacaucgagaucaucauccuggugacccugacccugcugaucuucgugcugcugagcauccugagcaagaccuacaucugcuaccugcugaugcccaucuucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagaagcagcggccugugccccggcuacaagagccugagagccgccagagugaugugcaagagcaagggccccgccagcauccugagcaucaucaccgccauccuggugcugaccuucgugacccccaucaacagcauggugaucggcgagagcaaggagguguucgagcuggaggagcugcccgacgacaugcuggagauggcccugaagaucaacuucuacuacuucgugugcgugaucaacuacgccgugaccuggggccugaucgugguggcccugcugaucggccugguguucaagaaguaccagcacagauuccugaaccuguacgccauguacugcgaggagugcgacauguaccacgacagaaccggccugaagagaaacggcgacuucaccaacaagugcagacagugcaccugcggccaguacgaggacgccaccggccugaucacccacagaaagaccuacaacugccuggugaaguacaagagcaaguggauccugaacuuccugaucaccuacauggugcugacccugaucaaggacagcgccaucguggugcaggccgccggcaccgacuucagcgccugccuggaggcccagagcguggacuggaacugcaccggccccuuccugaaccugggcaacugccagaagcagcagaagaaggagagcuacgccaacaucgccacccagcugaagggccugcaggccaucagcgugcuggacaugcccaugaucgccagcauccccgaggacaucgccggcgcccugagauacaucgaggagaaggagaccuuccacgugcagcugaccgccgaguacgccaugcugaccagauacugcgacuacuacacccaguucgccgacaacagcggcuacagccagaccaccuggagaguguaccugagaagccacgacuucgacgccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugaccgugcaccacgccuucagaggcaccagcagcgccuacaucgccaccaugcugagcaagaagagcaacaacgaccugguggccuacaccaacaagaucaaggagaaguuccccggcaacgcccugcugaaggccgugauggacuacaucagcuacaugaagagccugagcgagaugaccaacuucaaguacgacgaguucugggacgaccugcuguacagacccaaccccaccaaggcccccagccugagcagagagagcgagaccagcuacaacuucaagcuggugaucagccccaagagcaugaagagcugcaagaacgugaagagcguggugugccugagccccagaagcggcgccagcuacgacagcauccuggccugcggcgagcccaacggccccagcguguacagaaagcccagcggcggcguguuccagagcaacagcgacaagaccauguacugccuggccgacagccacugccuggaggacuucgaggugaucggccaggaggagcuggacgccaucaagaagagcgugugcugggccguggaguaccccgacgugacccugagcaagcugagcgacggcgugaagagcugcagaaugaaggacagcggcaagugcaacguggccgccaacagauggcccaucauccagugcgagaacgacaaguucuacuacagcgagcugcagaacgacuacgacaagacccaggacaucggccacuucugccugagccccggcugcagcaccgugagauuccccaucaaccagaagcacaucagcaacugcaacuggcaggugagcagaagcagcaucgccaagaucgacgugcacgacaucgaggacaucgaccaguacagaaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgagauccccgcccuggccggcaccagcgugggcuucaagaucaacagcaaggagggcaagcaccugcuggacaucaucggcuacgugaagagcgccagcuacagcagcguguacaccaagcuguacagcaccggccccaccagcggcaucaacaccaagcacgacgagcugugcaccggccccugccccgccaacaucaaccaccagaacggcuggcugaccuucgccaaggagagaaccagcagcuggggcugcgaggaguucggcugccuggccaucagcgacggcugcguguucggcagcugccaggacaucgugagagacgagcugagcguguacagaaaggagaccgaggaggugaccgacguggagcugugccugaccuucagcgacaagaccuacugcaccaaccugaaccccaucacccccaucaucaccgaccuguucgaggugcaguucaagaccguggagaccuacagccugcccagaaucguggccauccagaaccacgagaucaagaucggccagaucaacgaccugggcguguacagcaagggcugcggcaacgugcagaaggugaacggcaccguguacggcaacggcgugcccaaguucgacuaccugugccaccuggccagcagaaaggaggugaucgugagaaagugcuucgacaacgacuaccaggccugcaaguuccugcagacccccgccagcuacagacuggaggagaacagcggcaccaucaccgugaucgacuacaagaagauccugggcaccaucaagaugaaggccauccugggcgacgugaaguacaagaccuucgccgacaacguggacaucaccguggagggcagcugcgccggcugcaucaacugcuucgagaacauccacugcgagcugaccauccacaccaccaucgaggccagcugccccgugaccagccccugcaccguguuccacgacagaauccugaucacccccaacgagcacaaguacgccaugaagguggugugcaccgagaagcccggcaacacccugacccugaaggugugcaacaccaagguggacgccagccuggcccugaucgacgccaagcccauccuggagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccaucaucaucagcaucaucgugcugcugaucgugaucuacaucauccugcccgugugcuucaagcugagagacacccugagacagcacgaggacgccuacaagagagagaugaaggugagauga

SEQ ID NO: 9308 - RNA, 4326 nt, Artificial Sequence
  derived and/or modified CDS sequence (opt4) from CHATV(LEIV-22712)__HQ734822.1__GP
augaucuucauccugauccuguucgccgugagcgccgccagccccguguaccagagaugcuuccaggacggcgccaucgugaagcagaaccccagcaaggaggccgugaccgaggugugccugaaggacgacgugagcaugaucaagaccgaggccagauacaccaagaacgccaccggcaccuucagcaacaacguggccaucagaaaguggcuggugagcgacuggcacgacugcagacccaagaaggugagcggcggccacaucaacgugaucgaggugggcgacgaccugagccugcacaccgagagcuacgugugcagcgccgacugcaccaucggcguggacaaggagaccgcccagaucagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccgugcugcccggcagcaucgccaacagcaucugccagaacaucgagaucaucauccuggugacccugacccugcugaucuucgugcugcugagcauccugagcaagaccuacaucugcuaccugcugaugcccaucuucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagaagcagcggccugugccccggcuacaagagccugagagccgccagagugaugugcaagagcaagggccccgccagcgugcugagcaucaucaccgccauccuggugcugaccuucgugacccccaucaacagcaugguggugggcgagagcaaggagguguucgagcuggaggagcugcccgacgacaugcuggagauggcccugaagaucaacuucuacuacuucaucugcgugaugaacuacgccgugaccuggggccugaucguggugggccugcugaucggccugguguucaagaaguaccagcacagauuccugaaccuguacgccauguacugcgaggagugcgacauguaccacgacagaaccggccugaagagaaacggcgacuucaccaacaagugcagacagugcaccugcggccaguacgaggacgccaccggccugaucacccacagaaagaccuacaacugccuggugcaguacaagagcaaguggauccugaacuuccugaucgccuacaugacccugacccugaucaaggacagcgccaucaucgugcaggccaccggcaccgacuucaucagcugccuggagacccagagcgugaacuggaacugcaccggccccuuccugaaccugggcaacugccagaagcagcagaagaaggagcccuacgccaacaucgccacccagcugaagggccugcaggccaucagcgugcuggacauccccaugaucgccaacauccccgaggacaucgccggcgcccugagauacaucgaggagaaggagaccuuccacgugcagcugaccgccgaguacgccaugcugaccagauacugcgacuacuacacccaguucgccgacaacagcggcuacagccagaccaccuggagaguguaccugagaagccacgacuucgacgccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugaccaugcaccacgccuucagaggcaccagcagcgccuacaucgccacccugcugagcaagaagcugaacgacgaccuggccgccuacaccaacaagaucaaggagaaguuccccggcaacgcccugcugaaggccaugauggacuacaucagcuacaugaagagccugagcgagauggccaacuucaaguacgacgaguucugggacgaccugcugcacaagcccgaccccaccaaggccccccugcugagcagaggcagcgagcccguguacaacuucaagcugguggugagcagcagaagcgugaagagcugcaagaacgugaagagcguggugugccugagccccagaagcggcgugagcuacgacagcgugcuggccugcggcgagcccaacggccccagcguguacagaaagcccagcgacggcguguuccagagcaacagcgacaagaccaucuacugccuggccgacagccacugccuggaggacuucgaggugaucagccaggaggagcuggacgccaucaagaagagcgagugcugggugaucgaguaccccaacgugaagcugaccaagcccagcgacggcaucaagagcugcagaaugaaggacagcggcaagugcaacguggccaccaacagauggcccaucauccagugcgagaacaacaacuucuacuacagcgagcugcagaacgacuacgacaagacccaggacaucggccacuucugccugagccccggcugcagcaccaucagauaccccaucaaccagaagcacaucagcaacugcaacuggcaggugagccacagcagcaucgccaagaucgacgugcacaacaucgaggacaucgagcaguacagaaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaacagcaaggagggcaagcaccugcuggacgugaucggcuacgugaagagcgccagcuacagcagcguguacagcaagcuguacagcaccggccccaccagcggcaucaacaccaagcacgacgagcugugcaccggccccugccccgagaacaucaagcaccagaccggcuggcugaccuucgccagagagagaaccagcagcuggggcugcgaggaguucggcugccuggccaucagcgacggcugcguguucggcagcugccaggacaucgugaaggacgagcugagcguguacagaaaggagaccgaggaggugaccgacguggagcugugccugaccuucagcgacaagaccuacugcaccaaccugaaccccaucacccccaucaucaccaaccuguucgaggugcaguucaagaccguggagaccuacagccugcccagaaucguggccauccagaaccacgagaucaagaucggccagaucaacgaccugggcguguacagcaagggcugcggcaacgugcagaaggugaacggcaccguguacggcaacggcgugcccaaguucgacuaccugugccaccuggccagcagaaaggaggugaucgugagaaagugcuucgacaacgacuaccaggccugcaaguuccugcagacccccgccagcuacagacuggaggagaacagcggcgccaucaccgugaucgacuacaagaagauccugggcaccaucaagaugaaggccauccugggcgacgugaaguacaagaccuucgccgacaacguggacaucaccgccgagggcagcugcaccggcugcaucaacugcuucgagaacauccacugcgagcugaccauccacaccaccaucgaggccagcugccccgugaccagccccugcaccguguuccacgacagaauccuggugacccccaacgagcacaaguacgccaugaagguggugugcaccgagaagcccggcagcacccuggugaucaaggugugcaacaccaagaucgacgccagccuggcccugaucgacgccaagcccauccuggagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucaucgugcugcugaucgugaucuacaucauccugcccaucugcuucaagcugagagacacccugagaaagcacgaggacgccuacaagagagagaugaagaucagauga

SEQ ID NO: 9309 - RNA, 4332 nt, Artificial Sequence
  derived and/or modified CDS sequence (opt4) from INKV(KN3641)__U88059.1__GP
auggaggugcugaaccugaucuggcugcugacccugugcagcgccagccccguguuccagagaugcuuccaggacggcgccaucgugaagcagaaccccagcaaggaggccgugaccgaggugugccugaaggacgacgugagcaugaucaagaccgaggccaaguacaucaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggugaucuucaucuuccugaccaucgugagcaagaccuacgugugcuaccugcugaugcccaucuucauccccaucgccuacaucuacggcuggaucuacaacaagagcugcaagaagugcagacugugcggccugguguaccaccccuucaccgagugcggcacccacugcgugugcggcgccagauacgagaccagcgacagaaugaagcugcacagagccagcggccugugccccggcuacaagaaccugagagccgccagagugaugugcaagagcaagggccccgccagcgugcugagcaucaugaccgccgugcugauccugaccuucgugacccccaucagcgccauggugaucggcgagagcagcgagguguacacccugggcgaccugcccgacgacaugguggagauggccgagagagugaacaucuacuaccagaucaucaucaucaacuacagcaucaccuggguguuccugcugcugggccugaucaucgccuacuucuucagaaaguaccagcacagauuccugagcuucuacgccauguacugcaaggagugcgacauguaccacgagagagccggccugaccuacuggggcgacuucaccaacaagugcagacagugcaccugcggccaguucgaggacgugaccggccugauggugcacaagaagagcuacaacugcaucaucaaguacaaggccaaguggaucagagacaugcugaucaccuaccugcugaucaugcugaucaaggacagccugcuguucgugggcgccaccggcaccgacuucgccgccugcaucgacgagaagaccgugaccuggaacagaaccggccccuuccugaaccugggcagaugcgacaagagccagaagaagaccggcuacaccgacaucgccgaccagcugaagggccugggcgccaucagcgugcuggacauccccaugaucaagaagaugcccgacgagaucagcggcagccugaagugcaucgacgaccuggagacccaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaagcacggcgacaagugcaacagcgccaagugggacuucgccaacgagaugaagaccuucuacaccggccagaaggccaaguucaacaaggaccugaaccuggcccugcuggugcugcacaaggccuucagaggcaccggcaccagcuacaucgccgagagcauggccagaaaggacaacagaagcaugacccacuucgcccuggagaucaagaagaaguuccccaccaacgcccugcugaccgcccugaucgacuacaucagcuaccugcagagccccgccgagaugagcaccuucgagcuggacgaggacugggaggacuucaaguacaagcccgagcccaccgagagcccccagcugagaagccacagaaccgaccaguacaacuucaagaacgccgacagcaacagcaacgugaaggugugcaagaacauccagaaggugagcugcaucagccccagaagcagagccaaguucgagaacaucaucgccugcggcgagcacgccaaccccagcguguacaccaugcccaacgugagcaucuaccagagcaacagcgagagaagccacuacugcaucgccgacagccacugccuggaggaguacgaggugguggagaccgagcugcugaacgcccugaagaagagcaagugcugggccagagagauggacgacaucgugcugcacaagcagguggacggccugagaagcugcagaaugaaggacaccggcaacugcaacgugcaggagaacgacuggaccaucgugcugugcgagaacggcaacuacuacuacagcgaggcccacagagacuacgacaaggaccaggacgugggccacuucugccugagccccagaugcagcaccaucagauaccccaucagcaagagacacaucaagaacugcgacuggcagaucagccacagcaccaucgacaagaucagcgugcaggagcuggccgacaucgagcaguacaagaaggccaucagccagaagcugcagaccagccugagcaucuucaaguacgugaagaccaagaaccugccccacaucaagcccgccuacaaguacaucaccguggagggcguggagaccguggagggcaucgagaacgccuucaucgagagcgagauccccgcccuggccggcaccgccaucggcuucaagaucaacagcagagagggcaacuaccugauggacgugaucggcuacgugaagagcggcagcuacagcgccaccuacaccaagcuguacaucaccggccccaccaucggcgugaacaccaagcacgacgagaagugcaccggccccugccccgccaucaucgaccacaaggagggcuggcugaccuucgccaagggcagaaccagcaccuggggcugcgaggaguucggcugccuggccgugagcgacggcugcguguucggcagcugccaggacaucaucaaggacgagcuggccgugcacagaaagaccaccgaggagcccaccaccguggagcugugccugaccuucagcgacaagaccuacugcaccaaccugaacgccaucacccccaucaucaccgacaaguucgaggugcaguucaagaccguggagagcuacacccugcccagaaucaucgccaucaagaaccacgagaucaaggugggccagaucaacgaccugggcguguacagcaagggcugcggcaacgugcagaagaucaacggcaccaacuacggcaacggccugcccaaguucgacuaccugugccaccuggccggcagaaaggaggugaucaucagaaagugcuucgacaacgacuaccaggccugcaaguuccugcagagcccccccagcuacagacuggaggagcaccagggcaccgugaccgugaucgacuacaagaagauccugggcaccaucaagauggaggccauccugggcgacgugaaguacagaaacuaccagagcaacaucgagaucaacgccaagggcaccugcgccggcugcaucaacugcuucgagaacauccacugcgaguucaccauccacaccaccguggaggccagcugccccaucgugaccgacugggugagcuuccacgacagaauccugaucacccccgacgagcacaaguacgcccugaagguggugugccaggagaagcccaagcugagccugaaguucaagaucugcaacaccaacaucgacgccagcaugaccgugguggacagcaagcccauccuggagcuggcccccguggaccagaccaccuacaucagagagagagacgagagaugcaagaccuggaugugcagagugagagacgagggcuuccaggugauccuggagcccuucaagaaccuguucggcagcuacaucggcaucuucuacaccggcauccugugcaucgugugccugcugaucgugaucuacaucauccugcccaucugcuucaagcugagagacacccugagacagcuggaggacgccuacaagaaggaggugaagaucagauga

SEQ ID NO: 9310 - RNA, 4332 nt, Artificial Sequence
  derived and/or modified CDS sequence (opt4) from INKV(SWAR83-161)__U88060.1__GP
auggaggugcugaaccugaucuggcugcugacccugugcagcgccagccccguguuccagagaugcuuccaggacggcgccaucgugaagcagaaccccagcaaggaggccgugaccgaggugugccugaaggacgacgugagcaugaucaagaccgaggccaaguacaucaagaacgccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggccaucuucaucuuccugaccaucgugagcaagaccuacgugugcuaccugcugaugcccaucuucauccccaucgccuacaucuacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagaaccugagagccgccagagugaugugcaagagcaagggccccgccagcgugcugagcaucaugaccgccauccugauccugaccuucgugacccccaucagcgccauggugaucggcgagagcagcgagguguacacccuggacgagcugcccgacgacauggugcagauggccgagagagugaacaucuacuaccagaucaucaucaucaacuacagcaucaccugggccuuccugcuguucggccuggugcuggccuacuucuucaagaaguaccagcacagauuccugagcuucuacgccauguacugcaaggagugcgacauguaccacgagagagccggccugaccuacuggggcgacuucaccaacaagugcagacagugcaccugcggccaguucgaggacgugaccggccugauggugcacaagaagagcuacaacugcaucaucaaguacaaggccaaguggaucagagacauccugaucaccuaccugaucaucaugcugaucaaggacagccugcuguucgugggcgccaccggcaccgacuucgccgccugcaucgacgagaagaccgugaccuggaacugcaccggccccuuccugaaccugggcaagugcgacaagagccagaagaagaucggcuacgccgacaucgccgaccagcugaagggccugggcgccaucagcgugcuggacauccccaugaucaagagaaugcccgacgagaucagcggcagccugaaguacaucgacggccuggagaccuaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaagcacggcgacaagugcaacagcgccaagugggacuucgccaacgagaugaagaccuucuacaccggccagaaggccaaguucaacaaggaccugaaccuggcccugcuggugcugcacaaggccuucagaggcaccggcaccagcuacaucgccgagagcauggccagaaaggacaacagaagcaugacccacuucgcccuggagaucaagaagaaguuccccaccaacgcccugcugaccgcccugaucgacuacaucagcuaccugcagagccuggccgagaugagcaccuucgagcuggacgaggacugggaggacuucaaguacaagcccgagcccaccgaggccccccagcugagaagccacagaaccgaccaguacaacuucaagaacgccgacagcaacagcaacgugaaggugugcaagaacauccagaaggugagcugcaucagccccagaagcagagccaaguucgagaacaucaucgccugcggcgagcacgccaaccccagcguguacaugaugcccaacgugagcaucuaccagagcaacagcgagagaagccacuacugcaucgccgacagccacugccuggaggaguacgaggugguggagagcgagcugcugaacgcccugaagaagagcaagugcugggccaaggagauggacgacaucgugcugcacaagcagagcgacggccugagaagcugcagaaugaaggacaccggcaacugcaacgugcaggagaacgacuggaccaucgugcugugcgagaacggcaacuacuacuacagcgaggcccacagagacuacgacaaggaccaggacgugggccacuucugccugagccccagaugcagcaccaucagauaccccaucaacaagagacacaucagaaacugcgacuggcagaucagccacagcaccaucgacaagaucagcgugcaggagcuggccgacaucgagcaguacaagaaggccaucagccagaagcugcagaccagccugagcaucuucaaguacgugaagaccaagaaccugccccacaucaagcccgccuacaaguacaucaccguggagggcaucgagaccguggagggcaucgagaacgccuucaucgagagcgagauccccgcccuggccggcaccgccaucggcuucaagaucaacagcagagagggcaacuaccugauggacgugaucggcuacgugaagagcgccagcuacagcgccaccuacaccaagcuguacaccaccggccccaccaucggcgugaacaccaagcacgacgagaagugcaccggccccugcccccccaucaucgaccacaaggagggcuggcugaccuucgccaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagaaucaucgccaucaagaaccacgagaucaaggugggccagaucaacgaccugggcguguacagcaagggcugcggcaacgugcagaagaucaacggcaccaacuacggcaacggcgugcccaaguucgacuaccugugccaccuggccagcagaaaggaggugaucaucagaaagugcuucgacaacgacuaccaggccugcaaguuccugcagagcccccccagcuacagacuggaggagcaccagggcaccgugaccgugaucgacuacaagaagauccugggcaucaucaagaugaaggccauccugggcgacgugaaguacaagaacuaccagagcaacaucgagaucaacgccgagggcaccugcgccggcugcaucaacugcuucgagaacauccacugcgaguucaccauccacaccaccguggaggccagcugccccaucgugaccgacugcgugagcuuccacgacagaauccugaucacccccgacgagcacaaguacgcccugaagguggugugccaggagaagcccaagcugagccugaaguucaagaucugcaacaccaacaucgacgccagcaugaccaucguggacagcaagcccauccuggagcuggcccccguggaccagaccaccuacaucagagagaaggacgagagaugcaagaccuggaugugcagagugagagacgagggcuuccaggugauccuggagcccuucaagaaccuguucggcagcuacaucggcaucuucuacaccggcauccugugcaucaucugccugcugaucgugaucuacaucauccugcccaucugcuucaagcugagagacacccugagacagcacgaggacgccuacaagaaggagaugaagaucagauga

SEQ ID NO: 9311 - RNA, 4332 nt, Artificial Sequence
  derived and/or modified CDS sequence (opt4) from INKV(Lovanger)__KU681435.1__GP
auggaggugcugaaccugaucuggcugcugacccugugcagcgccagccccguguuccagagaugcuuccaggacggcgccaucgugaagcagaaccccagcaaggaggccgugaccgaggugugccugaaggacgacgugagcaugaucaagaccgaggccaaguacaucaagaacgccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggccaucuucaucuuccugaccaucgugagcaagaccuacgugugcuaccugcugaugcccaucuucauccccaucgccuacaucuacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcagaggccccgccagcgugcugagcaucaugaccgccauccugauccugaccuucgugacccccaucagcgccauggugaucggcgagagcagcgagguguacacccuggacgagcugcccgacgacauggugcagauggccgagagagugaacaucuacuaccagaucaucaucaucaacuacagcaucaccugggccuuccugcuguucggccuggugcuggccuacuucuucaagaaguaccagcacagauuccugagcuucuacgccauguacugcaaggagugcgacauguaccacgagagagccggccugaccuacuggggcgacuucaccaacaagugcagacagugcaccugcggccaguucgaggacgugaccggccugauggugcacaagaagagcuacaacugcaucaucaaguacaaggccaaguggaucagagacauccugaucaccuaccugaucaucaugcugaucaaggacagccugcuguucgugggcgccaccggcaccgacuucgccgccugcaucgacgagaagaccgugaccuggaacugcaccggccccuuccugaaccugggcagaugcgacaagagccagaagaagaucggcuacgccgacaucgccgaccagcugaagggccugggcgccaucagcgugcuggacauccccaugaucaagagaaugcccgacgagaucagcggcagccugaaguacaucgacggccuggagaccuaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaagcacggcgacaagugcaacagcgccaagugggacuucgccaacgagaugaagaccuucuacaccggccagaaggccaaguucaacaaggaccugaaccuggcccugcuggugcugcacaaggccuucagaggcaccggcaccagcuacaucgccgagagcauggccagaaaggacaacagaagcaugacccacuucgcccuggagaucaagaagaaguuccccaccaacgcccugcugaccgcccugaucgacuacaucagcuaccugcagagccuggccgagaugagcaccuucgagcuggacgaggacugggaggacuucaaguacaagcccgagcccaccgaggccccccagcugagaagccacagaaccgaccaguacaacuucaagaacgccgacagcaacagcaacgugaaggugugcaagaacauccagaaggugagcugcaucagccccagaagcagagccaaguucgagaacaucaucgccugcggcgagcacgccaaccccagcguguacaugaugcccaacgugagcaucuaccagagcaacagcgagagaagccacuacugcaucgccgacagccacugccuggaggaguacgaggugguggagagcgagcugcugaacgcccugaagaagagcaagugcugggccaaggagauggacgacaucgugcugcacaagcaggccgacggccugagaagcugcagaaugaaggacaccggcaacugcaacgugcaggagaacgacuggaccaucgugcugugcgagaacggcaacuacuacuacagcgaggcccacagagacuacgacaaggaccaggacgugggccacuucugccugagccccagaugcagcaccaucagauaccccaucaacaagagacacaucagaaacugcgacuggcagaucagccacagcaccaucgacaagaucagcgugcaggagcuggccgacaucgagcaguacaagaaggccaucagccagaagcugcagaccagccugagcaucuucaaguacgugaagaccaagaaccugccccacaucaagcccgccuacaaguacaucaccguggagggcguggagaccguggagggcaucgagaacgccuucaucgagagcgagauccccgcccuggccggcaccgccaucggcuucaagaucaacagcagagagggcaacuaccugauggacgugaucggcuacgugaagagcgccagcuacagcgccaccuacaccaagcuguacaccaccggccccaccaucggcgugaacaccaagcacgacgagaagugcaccggccccugcccccccaucaucgaccacaaggagggcuggcugaccuucgccaaggagagaaccagcaccuggggcugcgaggaguucggcugccuggccgugagcgacggcugcguguucggcagcugccaggacaucaucaaggacgagcuggugguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagaaucaucgccaucaagaaccacgagaucaaggugggccagaucaacgaccugggcguguacagcaagggcugcggcaacgugcagaagaucaacggcaccaacuacggcaacggcuggcccaaguucgacuaccugugccaccuggccagcagaaaggaggugaucaucagaaagugcuucgacaacgacuacaaggccugcaaguuccugcagagcccccccagcuacagacuggaggagcaccagggcaccgugaccgugaucgacuacaagaagauccugggcaccaucaagaugaaggccauccugggcgacgugaaguacaagaacuaccagagcaacaucgagaucaacgccgagggcaccugcgccggcugcaucaacugcuucgagaacauccacugcgaguucaccauccacaccaccguggaggccagcugccccaucgugaccgacugcgugagcuuccacgacagaauccugaucacccccgacgagcacaaguacgcccugaagguggugugccaggagaagcccaagcugagccugaaguucaagaucugcaacaccaacaucgacgccagcaugaccaucguggacagcaagcccauccuggagcuggcccccguggaccagaccaccuacaucagagagaaggacgagagaugcaagaccuggaugugcagagugagagacgagggcuuccaggugauccuggagcccuucaagaaccuguucggcagcuacaucggcaucuucuacaccggcauccugugcaucaucugccugcugaucaucaucuacaucauccugcccaucugcuucaagcugagagacacccugagacagcacgaggacgccuacaagaaggagaugaagaucagauga

SEQ ID NO: 9312 - RNA, 4332 nt, Artificial Sequence
  derived and/or modified CDS sequence (opt4) from INKV(Lovanger)__KX554936.1__GP
auggaggugcugaaccugaucuggcugcugacccugugcagcgccagccccguguuccagagaugcuuccaggacggcgccaucgugaagcagaaccccagcaaggaggccgugaccgaggugugccugaaggacgacgugagcaugaucaagaccgaggccaaguacaucaagaacgccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggccaucuucaucuuccugaccaucgugagcaagaccuacgugugcuaccugcugaugcccaucuucauccccaucgccuacaucuacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcagaggccccgccagcgugcugagcaucaugaccgccauccugauccugaccuucgugacccccaucagcgccauggugaucggcgagagcagcgagguguacacccuggacgagcugcccgacgacauggugcagauggccgagagagugaacaucuacuaccagaucaucaucaucaacuacggcaucaccugggccuuccugcuguucggccuggugcuggccuacuucuucaagaaguaccagcacagauuccugagcuucuacgccauguacugcaaggagugcgacauguaccacgagagagccggccugaccuacuggggcgacuucaccaacaagugcagacagugcaccugcggccaguucgaggacgugaccggccugauggugcacaagaagagcuacaacugcaucaucaaguacaaggccaaguggaucagagacauccugaucaccuaccugaucaucaugcugaucaaggacagccugcuguucgugggcgccaccggcaccgacuucgccgccugcaucgacgagaagaccgugaccuggaacugcaccggccccuuccugaaccugggcagaugcgacaagagccagaagaagaucggcuacgccgacaucgccgaccagcugaagggccugggcgccaucagcgugcuggacauccccaugaucaagagaauccccgacgagaucagcggcagccugaaguacaucgacggccuggagaccuaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaagcacggcgacaagugcaacagcgccaagugggacuucgccaacgagaugaagaccuucuacaccggccagaaggccaaguucaacaaggaccugaaccuggcccugcuggugcugcacaaggccuucagaggcaccggcaccagcuacaucgccgagagcauggccagaaaggacaacagaagcaugacccacuucgcccuggagaucaagaagaaguuccccaccaacgcccugcugaccgcccugaucgacuacaucagcuaccugcagagccuggccgagaugagcaccuucgagcuggacgaggacugggaggacuucaaguacaagcccgagcccaccgaggccccccagcugagaagccacagaaccgaccaguacaaccugaagaacgccgacagcaacagcaacgugaaggugugcaagaacauccagaaggugagcugcaucagccccagaagcagagccaaguucgagaacaucaucgccugcggcgagcacgccaaccccagcguguacaugaugcccaacgugagcaucuaccagagcaacagcgagagaagccacuacugcaucgccgacagccacugccuggaggaguacgaggugguggagagcgagcugcugaacgcccugaagaagagcaagugcugggccaaggagauggacgacaucgugcugcacaagcaggccgacggccugagaagcugcagaaugaaggacaccggcaacugcaacgugcaggagaacgacuggaccaucgugcugugcgagaacggcaacuacuacuacagcgaggcccacagagacuacgacaaggaccaggacgugggccacuucugccugagccccagaugcagcaccaucagauaccccaucaacaagagacacaucagaaacugcgacuggcagaucagccacagcaccaucgacaagaucagcgugcaggagcuggccgacaucgagcaguacaagaaggccaucagccagaagcugcagaccagccugagcaucuucaaguacgugaagaccaagaaccugccccacaucaagcccgccuacaaguacaucaccguggagggcguggagaccguggagggcaucgagaacgccuucaucgagagcgagauccccgcccuggccggcaccgccaucggcuucaagaucaacagcagagagggcaacuaccugauggacgugaucggcuacgugaagagcgccagcuacagcgccaccuacaccaagcuguacaccaccggccccaccaucggcgugaacaccaagcacgacgagaagugcaccggccccugcccccccaucaucgaccacaaggagggcuggcugaccuucgccaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagaaucaucgccaucaagaaccacgagaucaaggugggccagaucaacgaccugggcguguacagcaagggcugcggcaacgugcagaagaucaacggcaccaacuacggcaacggccugcccaaguucgacuaccugugccaccuggccagcagaaaggaggugaucaucagaaagugcuucgacaacgacuaccaggccugcaaguuccugcagagcccccccagcuacagacuggaggagcaccagggcaccgugaccgugaucgacuacaagaagauccugggcaccaucaagaugaaggccauccugggcgacgugaaguacaagaacuaccagagcaacaucgagaucaacgccgagggcaccugcgccggcugcaucaacugcuucgagaacauccacugcgaguucaccauccacaccaccguggaggccagcugccccaucgugaccgacugcgugagcuuccacgacagaauccugaucacccccgacgagcacaaguacgcccugaagguggugugccaggagaagcccaagcugagccugaaguucaagaucugcaacaccaacaucgacgccagcaugaccaucguggacagcaagcccauccuggagcuggcccccguggaccagaccaccuacaucagagagaaggacgagagaugcaagaccuggaugugcagagugagagacgagggcuuccaggugauccuggagcccuucaagaaccuguucggcagcuacaucggcaucuucuacaccggcauccugugcaucaucugccugcugaucgugaucuacaucauccugcccaucugcuucaagcugagagacacccugagacagcacgaggacgccuacaagaaggagaugaagaucagauga

SEQ ID NO: 9313 - RNA, 4335 nt, Artificial Sequence
  derived and/or modified CDS sequence (opt4) from JSV__AF123487.1__GP
auggaggugcugaaccugaucuggcugcuggcccugugcagcgccagccccguguuccagagaugcuuccaggacggcgccaucgugaagcagaaccccagcaaggaggccgugaccgaggugugccugaaggacgacgugagcaugaucaagaccgaggccaaguacgugaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggugaucuucaucuuccugagcaucgugagcaagaccuacgugugcuaccugcugaugcccaucuucauccccaucgccuucaucuacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaugaccgccauccugauccugaccuucgugacccccaucagcgccauggugaucggcgagagcagcgagguguacacccuggacgaccugcccgacgacauggugcagauggccgagagagugaacaucuacuaccagaucaucaucaucaacuacggcgugaccugggccuuccugcugcugggccugauccuggccuacuucuucaagaaguaccagcacaaguuccuggacuucuacgccauguacugcgaggagugcgacauguaccacgagaagagcggccugacccacuggggcgacuucaccaacaagugcagacagugcaccugcggccaguucgaggacguggccggccugaugauccacagaaagagcuacaacugccuggugaaguacaaggccagauggaucagagacauccugaucauguaccuggccaugauccugaucaaggacagccugcuguucgugggcgccagcggcaccgacuucgccgccugcaucgacgagaagguggugaccuggaacugcaccggccccuuccugaaccugggcagaugcgacaagagccagaagaagaccaacuacgagggcaucgccaaccagcugaagggccugggcgugaucagcgugcuggacauccccaugaucaagaacaugcccgacgagaucagcggcagccugaaguacaucgacagccuggagaccuaccacgagcagcugaccgccgaguacgccuuccugaccagauacugcgacuacuacacccaguacaccgacaacagcggcuacagcagaaccguguggagaaccuaccugagaagccacgacuucggcgccugcgugguguaccccaaccaccaccugugcagaugcgugaaguacggcgacaagugcaacagcgccaagugggacuucgccaacgagaugaagaccuucuacaccggccagaaggugaaguucaacaaggaccugaaccuggcccugcuggugcugcacaaggccuucagaggcaccggcaccgccuacguggccgaggccauggccagaaaggacaacggcagcauggcccacuucgcccuggagaucagaaagaaguuccccaccaacgcccugcuggccgcccugaucgacuacaucguguaccugcagagccuggccgagaucgccaccuucgagcuggacgaggacugggaggacuucaaguacaagcccgagcccaccgagagcaccccccaggccagaagccacagaaacgaccaguacaacuucaagaacgccgagagcaacagcaacaccaaggugugcaagaacgugcagaaggugcugugcaucagccccagaagcaaggccaaguucgagaacaucaucgccugcggcgagcacgccaaccccagcguguacaugaugcccaacgugagcaucuaccagagcaacagcgagagaagccacuacugcaucgccgacagccacugccuggagaaguacgaggugguggagaccgagcugcugaacgcccugaagaagagcaagugcugggccaaggagauggacgacaucgugcugcacaagcagagcgacggccugagaagcugcagaaucaaggacaccggcaacugcaacgugcaggagaacgacuggaccaucgugcugugcgagaacggcaacuacuacuacagcgaggugcacaaggacuacgacaaggaccaggacgugggccacuucugccugagccccagaugcaccaccaucagauaccccaucagcagaagacacaucagaaagugcgaguggcagaucagccacagcaccaucgacaagaucagcgugcaggagcuggccgacaucgagcaguacaagaaggccaucagccagaagcugcagaccagccugagcaucuucaaguacgugagaaccaagaaccugccccacaucaagcccgccuacaaguacaucaccguggagggcguggagaccaucgagggcaucgagaacgccuucaucgagagcgagauccccgcccuggccggcaccgccaucggcuucaagaucaacagcagagagggcaacuaccugauggacgugaucggcuacgugaagagcgccagcuacagcgccguguacaccaagcuguacaccaccggccccaccaucggcaucaacaccaagcacgacgagaagugcaccggccccugccccgccgugaucgaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagagugaucgccaucaagaaccacgagaucaaggugggccagaucaacgaccugggcguguacagcaagggcugcggcaacgugcagaaggugaacggcaccaacuacggcaacggcagccccagauucgacuaccugugccaccuggccagcagaaaggaggugauccugagaaagugcuucgacaacgacuaccaggccugcaaguuccugcagagccccagcagcuacagacuggaggagcaccagggcaccgugaccgugaucgacuacaagaagauccugggcaccaucaagaugaaggccauccugggcgacgugaucuacaucaacuaccagaacaacaucgagaucaacgccgagggcaccugcgccggcugcaucgacugcuucgagaacauccacugcgaguucaccauccacaccaccguggaggccagcugccccaucaccaccgagugcgugagcuuccacgacagaauccugaucacccccgacgagcacaaguacgcccugaagaucgugugccacgacaagcccaaggugagccugaaguucaagaucugcaacaccaacguggacgccgccaugaccaucguggacagcaagcccauccuggagcuggcccccguggaccagaccaccuacaucagagagaaggacgagagaugcaagaccuggaugugcagagugagagacgagggcuuccaggugauccuggagcccuucaagaaccuguucggcagcuacaucggcaucuucuacaccggcauccugagcaucaucugccugcugaucgugguguacaucauccugcccaucugcuucaagcugagagacacccugagacagcacgaggacgccuacagaaaggagaugaagaucagauga

SEQ ID NO: 9314 - RNA, 4335 nt, Artificial Sequence
  derived and/or modified CDS sequence (opt4) from JSV(BFS 4474)__KX817319.1__GP
auggaggugcugaaccugaucuggcugcuggcccugugcagcgccagccccguguuccagagaugcuuccaggacggcgccaucgugaagcagaaccccagcaaggaggccgugaccgaggugugccugaaggacgacgugagcaugaucaagaccgaggccaaguacgugaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggugaucuucaucuuccugagcaucgugagcaagaccuacgugugcuaccugcugaugcccaucuucauccccaucgccuucaucuacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaugaccgccauccugauccugaccuucgugacccccaucagcgccauggugaucggcgagagcagcgagguguacacccuggacgaccugcccgacgacauggugcagauggccgagagagugaacaucuacuaccagaucaucaucaucaacuacggcgugaccugggccuuccugcugcugggccugauccuggccuacuucuucaagaaguaccagcacaaguuccuggacuucuacgccauguacugcgaggagugcgacauguaccacgagaagagcggccugacccacuggggcgacuucaccaacaagugcagacagugcaccugcggccaguucgaggacguggccggccugaugauccacagaaagagcuacaacugccuggugaaguacaaggccagauggaucagagacauccugaucauguaccuggccaugauccugaucaaggacagccugcuguucgugggcgccagcggcaccgacuucgccgccugcaucgacgagaagguggugaccuggaacugcaccggccccuuccugaaccugggcagaugcgacaagagccagaagaagaccaacuacgagggcaucgccaaccagcugaagggccugggcgugaucagcgugcuggacauccccaugaucaagaacaugcccgacgagaucagcggcagccugaaguacaucgacagccuggagaccuaccacgagcagcugaccgccgaguacgccuuccugaccagauacugcgacuacuacacccaguacaccgacaacagcggcuacagcaagaccguguggagaaccuaccugagaagccacgacuucggcgccugcgugguguaccccaaccagcacuucugcagaugcgugaaguacggcgacaagugcaacagcgccaagugggacuucgccaacgagaugaagaccuucuacaccggccagaaggugaaguucaacaaggaccugaaccuggcccugcuggugcugcacaaggccuucagaggcaccggcaccgccuacguggccgaggccauggccagaaaggacaacggcagcauggcccacuucgcccuggagaucagaaagaaguuccccaccaacgcccugcuggccgcccugaucgacuacaucguguaccugcagagccuggccgagaucgccaccuucgagcuggacgaggacugggaggacuucaaguacaagcccgagcccaccgagagcaccccccaggccagaagccacagaaacgaccaguacaacuucaagaacgccgagagcaacagcaacaccaaggugugcaagaacgugcagaaggugcugugcaucagccccagaagcaaggccaaguucgagaacaucaucgccugcggcgagcacgccaaccccagcguguacaugaugcccaacgugagcaucuaccagagcaacagcgagagaagccacuacugcaucgccgacagccacugccuggagaaguacgaggugguggagaccgagcugcugaacgcccugaagaagagcaagugcugggccaaggagauggacgacaucgugcugcacaagcagagcgacggccugagaagcugcagaaucaaggacaccggcaacugcaacgugcaggagaacgacuggaccaucgugcugugcgagaacggcaacuacuacuacagcgaggugcacaaggacuacgacaaggaccaggacgugggccacuucugccugagccccagaugcaccaccaucagauaccccaucagcagaagacacaucagaaagugcgaguggcagaucagccacagcaccaucgacaagaucagcgugcaggagcuggccgacaucgagcaguacaagaaggccaucagccagaagcugcagaccagccugagcaucuucaaguacgugagaaccaagaaccugccccacaucaagcccgccuacaaguacaucaccguggagggcguggagaccaucgagggcaucgagaacgccuucaucgagagcgagauccccgcccuggccggcaccgccaucggcuucaagaucaacagcagagagggcaacuaccugauggacgugaucggcuacgugaagagcgccagcuacagcgccguguacaccaagcuguacaccaccggccccaccaucggcaucaacaccaagcacgacgagaagugcaccggccccugccccgccgugaucgaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagagugaucgccaucaagaaccacgagaucaaggugggccagaucaacgaccugggcguguacagcaagggcugcggcaacgugcagaaggugaacggcaccaacuacggcaacggcagccccagauucgacuaccugugccaccuggccagcagaaaggaggugauccugagaaagugcuucgacaacgacuaccaggccugcaaguuccugcagagccccagcagcuacagacuggaggagcaccagggcaccgugaccgugaucgacuacaagaagauccugggcaccaucaagaugaaggccauccugggcgacgugaaguacaagaacuaccagaacaacaucgagaucaacgccgagggcaccugcgccggcugcaucgacugcuucgagaacauccacugcgaguucaccauccacaccaccguggaggccagcugccccaucaccaccgagugcgugagcuuccacgacagaauccugaucacccccgacgagcacaaguacgcccugaagaucgugugccacgacaagcccaaggugagccugaaguucaagaucugcaacaccaacguggacgccgccaugaccaucguggacagcaagcccauccuggagcuggcccccguggaccagaccaccuacaucagagagaaggacgagagaugcaagaccuggaugugcagagugagagacgagggcuuccaggugauccuggagcccuucaagaaccuguucggcagcuacaucggcaucuucuacaccggcauccugagcaucaucugccugcugaucgugguguacaucauccugcccaucugcuucaagcugagagacacccugagacagcacgaggacgccuacagaaaggagaugaagaucagauga

SEQ ID NO: 9315 - RNA, 4323 nt, Artificial Sequence
  derived and/or modified CDS sequence (opt4) from LUMV__AF123484.1__GP
augauccuggugcuguucuucguggcccugagcgccgccggccccguguaccagagaugcuuccaggacggcgccaucgugaagcagagccccagcaagcaggccgugaccgaggugugccugaaggacgacgugagcaugaucaagaccgaggccagauacuucaagaacaccaccggcaucuacgccaacaacguggccaucagaaaguggcugguggccgacuggcacgacugcagacccaagaaggugagcggcggccacaucaacgugaucgaggugggcgacgaccugacccugcacaccgaggccuacgugugcaacgccgacugcaucaucggcguggacaaggagaccgcccaggugagacugcagaccgacaccaccaaccacuucgagaucgccggcaccaccgugaagagcggcugguucaagagcaccaccuacaucacccugggccagaccugcgagcaccugaaggugagcugcggccccaagagcauccaguuccacgccugcuucaaccagcacaugagcugcgugagauuccugcacagaaccauccugcccggcagcaucgccaacagcgugugccagaacaucgagaucaucauccugaccgugcugacccugcugaucuucacccugcugagcauccugagcaagaccuacaucugcuacauccugaugcccaucuucaucccccuggccuacaucuacggccugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcgugcugagcaucaucaccgccgugcugauccugaccuucaucacccccaucaacgccaugaucgccggcgagacccaggagaccuucaagcuggaggaccugcccgacgacaugcugagcauggccaugaagaucaacauguacuacaucaugugcaugcugaacuacguggccaccuggagcuucaucuucugcgcccugaucaucgcccugaucuucaagaaguaccagcacaaguuccugagcuacuacgccauguacugccaggagugcgacauguaccacgacagaagcggccugaaguacaacggcggcuucaccaacaagugcagacagugcaccugcggccaguacgaggacgccaccggccugauggcccacagaaagaccuacaacugccugauccaguacaagagcaaguggcuggugaacuuccugaucaccuacaucauccugaugcugaucaaggacagcgugcugaucgugcacgccgagggcaccgacuucgagaagugcagcagcgacaucaacaucguguggaacugcaccggccccuuccugagccugggcaacugcgagaagaagcagaagaaggagagcuacaacgacaucgccgcccagcugaagggccuggacgccaucagcgugcuggacauccccaugaucagcaagauccccgaggacaucgccggcgcccugagauucaucgaggagcagaacagcuaccacgugcagcugaccguggaguacgccaugcugaccagauacugcgacuacuacacccaguucagcgacaacagcggcuacagccagaccaccuggagaaccuaccugagaagccacgacuucgaggccugcauccuguaccccaaccagcacuucugcagaugcgugaagcacggcgacaagugcagcagaagcaacugggacuucgccaacgagaugaagaacuacuacagcggcaagcagagcaaguacaacaaggaccugaaccuggcccugaugagcuuccaccacgccuucagaggcaccagcagcuucuacaccgccaagcugcugagagagaagaagaccgaggagcugaagaacuacaucgacaagaucagaaccgaguaccccggcaacgcccugcugaaggccgugaucgacuacaucaaguacaugaugggccugaccgaggugagcaacuucaagcacgacgagaugugggacgacuucaucuucgagaaccccagcaccagaagcagccugagcagaaacagcgagagcagcuacgacuucaagaccaacaucaacagcgaccccaccaacaccugcaagaacaucaaggccgugaccugccugagccccaagagcggcgugagcuucgacagcgugaucgccugcggcgagagcaaccagcccagcaucuaccagaagcccagaaagcagguguaccagagcaacagcgagcagacccacuucugccugcuggacacccacugccuggagggcuacgagaccgugggcgaggaggugcugagcgccaucaagaagagcaagugcugggagaccgacuucaccgaguacauccaguucaagcagagcgacggcgugagaagcugcagaaugaaggacagcggcgagugcaccgugaccaccaacaaguggcccaucauccugugcgagaacaacagauacuacuacagcgagcugcacaaggacuacgacaaggaccaggacaucggccacuucugccugagccccagaugcaacaccaucagauaccccaucaaccagaaccacaucagcaacugcaccuggcaggugagacacaacaacaucgacaagaucgaggugcacgagcuggaggaccuggagcaguacagaaaggccaucacccagaagcugcagaccagccugacccuguucaaguacagcagaaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucagcuacgugaagagcgccagcuacagcgccguguacaccaagcuguacaccaccggccccaccaucggcgugaacaccaagcacgacgagcugugcaccggcagcugccccgugaacgugccccacaacaccggcuggcugaccuucgccagagagagaaccagcagcuggggcugcgaggaguucggcugccuggccaucagcgacggcugcguguucggcagcugccaggacaucaucaaggacgagcugaccguguacagagaggagaccgaggagaccaccaacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaagaucaacaacaccaacuacggcaacggcgugcccaaguucgacuaccugugccaccuggccagcagaaaggaggugaucaucagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggacaucaccguggagggcgccugcaccggcugcaucaacugcuucgacaacauccacugcgagcugaccauccacagcaccguggaggccagcugccccaucaccagcagcugcaccguguuccacgacagaauccugaucacccccaacgagcacaaguacgccaucaaggugaucugcaacggcaagcccggcaucagccugcccuucaagaucugcaacaccaagguggacgccgccaugacccugaccgacgccaagcagauccuggagcuggcccccguggaccagaccaccuacaucaaggagaaggacgagagaugcaagaccuggaugugcagagugagagacgagggccugcaggugaucuucgagcccuucaagaaccuguucggcagcuacaucggcaucuucuacaccuucgugaucuuccugguggugaucuucaucgugaucuacaucgugcugcccaucugcuucaagcugagagacacccugagacagcacgaggacgccuacaagagagagaugaagaucagauga

SEQ ID NO: 9316 - RNA, 4323 nt, Artificial Sequence
  derived and/or modified CDS sequence (opt4) from LUMV(SAAr 1881)__KX817325.1__GP
augauccuggugcuguucuucguggcccugagcgccgccggccccguguaccagagaugcuuccaggacggcgccaucgugaagcagagccccagcaagcaggccgugaccgaggugugccugaaggacgacgugagcaugaucaagaccgaggccagauacuucaagaacaccaccggcaucuacgccaacaacguggccaucagaaaguggcugguggccgacuggcacgacugcagacccaagaaggugagcggcggccacaucaacgugaucgaggugggcgacgaccugacccugcacaccgaggccuacgugugcaacgccgacugcaucaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcgugugccagaacaucgagaucaucauccugaccgugcugacccugcugaucuucacccugcugagcauccugagcaagaccuacaucugcuacauccugaugcccaucuucaucccccuggccuacaucuacggccugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcgugcugagcaucaucaccgccgugcugauccugaccuucaucacccccaucaacgccaugaucgccggcgagacccaggagaccuucaagcuggaggaccugcccgacgacaugcugagcauggccaugaagaucaacauguacuacaucaugugcaugcugaacuacguggccaccuggagcuucaucuucugcgcccugaucaucgcccugaucuucaagaaguaccagcacaaguuccugagcuacuacgccauguacugccaggagugcgacauguaccacgacagaagcggccugaaguacaacggcggcuucaccaacaagugcagacagugcaccugcggccaguacgaggacgccaccggccugauggcccacagaaagaccuacaacugccugauccaguacaagagcaaguggcuggugaacuuccugaucaccuacaucauccugaugcugaucaaggacagcgugcugaucgugcacgccgagggcaccgacuucgagaagugcagcagcgacaucaacaucguguggaacugcaccggccccuuccugagccugggcaacugcgagaagaagcagaagaaggagagcuacaacgacaucgccgcccagcugaagggccuggacgccaucagcgugcuggacauccccaugaucagcaagauccccgaggacaucgccggcgcccugagauucaucgaggagcagaacagcuaccacgugcagcugaccguggaguacgccaugcugaccagauacugcgacuacuacacccaguucagcgacaacagcggcuacagccagaccaccuggagaaccuaccugagaagccacgacuucgaggccugcauccuguaccccaaccagcacuucugcagaugcgugaagcacggcgacaagugcagcagaagcaacugggacuucgccaacgagaugaagaacuacuacagcggcaagcagagcaaguacaacaaggaccugaaccuggcccugaugagcuuccaccacgccuucagaggcaccagcagcuucuacaccgccaagcugcugagagagaagaagaccgaggagcugaagaacuacaucgacaagaucagaaccaaguaccccggcaacgcccugcugaaggccgugaucgacuacaucaaguacaugaugggccugaccgaggugagcaacuucaagcacgacgagaugugggacgacuucaucuucgagaaccccagcaccagaagcagccugagcagaaacagcgagagcagcuacgacuucaagaccaacaucaacagcgaccccaccaacaccugcaagaacaucaaggccgugaccugccugagccccaagagcggcgugagcuucgacagcgugaucgccugcggcgagagcaaccagcccagcaucuaccagaagcccagaaagcagguguaccagagcaacagcgagcagacccacuucugccugcuggacacccacugccuggagggcuacgagaccgugggcgaggaggugcugagcgccaucaagaagagcaagugcugggagaccgacuucaccgaguacauccaguucaagcagagcgacggcgugagaagcugcagaaugaaggacagcggcgagugcaccgugaccaccaacaaguggcccaucauccugugcgagaacaacagauacuacuacagcgagcugcacaaggacuacgacaaggaccaggacaucggccacuucugccugagccccagaugcaacaccaucagauaccccaucaaccagaaccacaucagcaacugcaccuggcaggugagacacaacaacaucgacaagaucgaggugcacgagcuggaggaccuggagcaguacagaaaggccaucacccagaagcugcagaccagccugacccuguucaaguacagcagaaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucagcuacgugaagagcgccagcuacagcgccguguacaccaagcuguacaccaccggccccaccaucggcgugaacaccaagcacgacgagcugugcaccggcagcugccccgugaacgugccccacaacaccggcuggcugaccuucgccagagagagaaccagcagcuggggcugcgaggaguucggcugccuggccaucagcgacggcugcguguucggcagcugccaggacaucaucaaggacgagcugaccguguacagaaaggagaccgaggagaccaccaacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaagaucaacaacaccaacuacggcaacggcgugcccaaguucgacuaccugugccaccuggccagcagaaaggaggugaucaucagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggacaucaccguggagggcgccugcaccggcugcaucaacugcuucgacaacauccacugcgagcugaccauccacagcaccguggaggccagcugccccaucaccagcagcugcaccguguuccacgacagaauccugaucacccccaacgagcacaaguacgccaucaaggugaucugcaacggcaagcccggcaucagccugcccuucaagaucugcaacaccaagguggacgccgccaugacccugaccgacgccaagcagauccuggagcuggcccccguggaccagaccaccuacaucaaggagaaggacgagagaugcaagaccuggaugugcagagugagagacgagggccugcaggugaucuucgagcccuucaagaaccuguucggcagcuacaucggcaucuucuacaccuucgugaucuuccugguggugaucuucaucgugaucuacaucgugcugcccaucugcuucaagcugagagacacccugagacagcacgaggacgccuacaagagagagaugaagaucagauga

SEQ ID NO: 9317 - RNA, 4329 nt, Artificial Sequence
  derived and/or modified CDS sequence (opt4) from MELV__U88057.1__GP
augaucgcccugaucuuccugaucgccaucgccgccgccagccccguguaccagagaugcuuccaggacggcggcaucgugaagcagaaccccagcaaggacgccgugaccgaggugugccugaaggacgacgugagcaugaucaagaccgaggccaaguacaugaagaacgacaccggcaccuucagcaacaacguggccaugagaaaguggcugguggccgacuggcacgacugcagaccccagaagagcagcggcggccacaucaacgugaucgaggugggcgacgaccugagccugcacaccgaggccuacaucugcagcgccgacugcaugaucagcguggacaaggagaccgcccagaucagacugcagaccgacagcaccacccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugacccugcugaucuucaucuuccugagcauccugagcaagaccuacaucugcuacauccugaugcccauguucauccccguggccuacaucuacggcuggaucuacaacaagagcugcaagaagugcaagcugugcggccugguguaccaccccuucaccgagugcggcacccacugcgugugcggcgccagauacgagaccagcgacagaaugaagcugcacagaagcagcggccugugccccggcuacaagagccugagagccgccagagugaugugcaagagcaagggccccgccagcauccugagcgugcugaccgccgugcugauccugaccuucgugacccccaugaacgcccugacccugggcagcagcgaggagaacuacaagcuggagaaccugcccgacgacaugcuggacauggccgagagaaucgacaucuacuaccugagcaucauccugaacuacagcaucaccuggggccuggugauccugcugggccugaccuucauccuguucagaagauuccagcacagauuccugaacugcuacgccauguacugcagcgagugcgacauguaccacgacaagaacggccuggugagaaacggcgacuucaccaacaagugcagacagugcaccugcggccaguacgaggacgccgccggccugaucauccaccagaagagcuacaacugccugaucaaguacaaggccaaguggaucagaaacauccugcugaccuacaucauccugauccugaucaaggacagcgugcugcugaccagcgccgagggccccgacuucagcgugugcaucgagcagaaggccaucagcuggaacugcaccggccccuuccugaaccugggcagaugcgagaagacccagaagaaggccagcuacgccaccaucgccacccagcugagaagcaucgacgccaucagcgugcuggacauccccaugaucgccaagauccccgaggacaucagcggcgcccugaaguacaucgagagccugaagaccuaccacgagcagcugaccgccgaguacgccaugcugaccagauacugcgacuacuacacccaguucagcgacaacagcggcuacagccagaccagcuggagaaaguuccugagaagccacgacuucgagagcugcaucaucuaccccaaccagcacuucugcagaugcgugaagcaggacgagaagugcagcagcgccaagugggacuucgccagcgagaugaagggcuucuaccugaacaagcaggccaaguucaacaaggaccugaaccuggcccugagcaccuuccacaaggccuucagaggcacccccaucagcuacgugaccgagcugaucagcaagaacaagaacagcagccugcugauguacgugagcgagaucaagagaaaguuccccggcaacgcccugcugguggcccugcuggacuucaucauguaccugcagagccugagcgagaucagcggcuucgagcugggcgacgagugggaggacuucaaguacgaccccgagcccaccgagcccgcccugaugcccagaagccacagaagcgaccaguacaacuucaagaacgccgccagcgugagcaagaccaagaccugcgagaacaucaagagagugcugugccugagccccagaagcagagccaccuucgacgacgugguggccugcggcgaguucgccaaccccagcguguacaugcugcccaacaucaccaucuaccagagcaacaucgagagaagccacuacugcaucgccgacagccacugccuggaggaguucgagcuggugaagcccgagcugcugaccgcccugaagaagagcaccugcugggccggcgagaucgacgacaucgugcugcacaagcagagcgacggccugagaagcugcagaaucaaggacaccggcaccugcgacgugcugggcaacgaguggaccaucgugcugugcgagaacaacaacuucuacuacagcgaggugcacagagacuacgacaaggaccaggacaucggccacuucugccugagccccagaugcaacaucaucagauaccccaucaaccccagacacaucagaaccugcaaguggcagaucagccacagcaccaucgacaagaucaccgugcacgagcuggccgacaucgagcaguacaagaaggccaucacccagaagcugcagaacagccugagcaucuucaaguacaagagaaccaagaaccugccccacaucaagcccaucuacaaguacaucgccaucgagggcaccgagaccguggagggcaucgagaacgccuacaucgagagcgagauccccgcccuggccggcaccgccaucggcuucaagaucaacagcaaggacggcaaccaccugauggacgugaucggcuacgugaagagcgccagcuacagcagcaccuacaccaagcuguacaccaccggccccaccaucggcaucaacaccaagcacgacgagaagugcaccggcagcugccccacccaggugaagcacaagaccggcuggcugaccuucgccaaggagagaaccagcaccuggggcugcgaggaguucggcugccuggccaucagcgacggcugcguguucggcagcugccaggacaucaucaaggacgagcugaccguguacagaaagaccaccgacgaggugaccgagcuggagcugugccugaccuucgccgacaagaccuacugcaccaaccugaacgccgugacccccaucaucaccgacaaguucgaggugcaguucaagaccguggagagcuacagccugcccagaaucaucgccgugaagaaccacgagaucaaggugggccagaucaacgacaucggcguguacagcaagggcugcggcaacgugcagaaggugaacggcaccagcuacggcaacggcgugcccaaguucgacuaccugugccaccuggccagcagaaaggaggugaccaucagaaagugcuucgacaacgacuaccaggccugcaaguuccugcagacccccagcagcuacagacuggaggagcaccagggcaccgugaccaucaucgacuacaagaagauccugggcagcaucaagaugaaggccauccugggcgacgugaaguacaagaacuacgccagcaacaucgacaucaacgccgagggcagcugcgccggcugcaucaacugcuucgagaacauccacugcgaguucaccauccacagcaccguggagaccagcugccagaucgagagcgacugcaccagcuuccacgacagagugcugaucacccccaacgagcacaaguacgcccugaagcugaucugccacgacaagcccgccagcagccugaaguucaagaucugcaacaccaagguggaggccgccaugacccugguggacgccagacccaucaucgagcuggcccccguggaccagaccgccuacaucagagagaaggacgagagaugcaagaccuggaugugcagagugagagacgagggcauccaggugaucuucgagcccuucaagaaccuguucggcagcuacaucggcaucuucuacgccaucgugaucugcaucaucgugcuguuccugaucguguacaucgugcugcccaucugcuucaagcugaaggacacccugaagcagcacgaggacgccuacaagagagagaugaagaucagauga

SEQ ID NO: 9318 - RNA, 4326 nt, Artificial Sequence
  derived and/or modified CDS sequence (opt4) from SAV__AF123486.1__GP
augaucccccugcuguuccuggugacccuggugagcgccggccccguguuccagagaugcuuccaggacggcgccaucgugaagcagaaccccagcaaggaggccgugaccgaggugugcaucaaggacgacgugagcaugaucaagaccgaggccagauacgugagaaacagcagcggcguguucagcaacaacguggcccugagaaaguggcuggugagcgacuggcacgacugcaagcccaagaaggugagcggcggccacaucaacgugaucgaggugggcaacgaccugacccugcacaccgagagcuacgugugcagcgccgacugcaccaucggcaucgacaaggagaccgcccagaucagacugcagaccgacaccaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcauggccaacagcaucugccagaacaucgagaucaucauccugaccacccuggcccugcugaucuuccugcugcugaccauccugagcaagaccuacaucugcuaccugcugaugcccaucuucauccccaucgcccaccuguacggccugaucuacaacaagagcugcaagaagugccagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcaaccugagcaucaucaccgccgugcugacccugaccuucgugacccccaucaacggccugaccaucggcgacagcaaggaggugcugaaccccgacgagcugcccgacgacaugcuggagauggcccagaagcugaacauguaccagcugaucugcaucaucaacuacaccgccaccuggagcaucaucaucaucggccuggccguguucuacaucuucaagaaguaccagcacagauucuacaacuacuacgccauguacugccaggagugcgacauguaccacgagagaagcggccugaaguggaacggcgacuucaccaacaagugcagacagugcaccugcggcgaguacgaggacgccgccggccugaucagccacagaaagagcuacaacugccugcugcaguacaaggugaagugggugaugaacuuccugaccaucuacguggcccugaucauccugaaggacagcacccugaucgugcaggccgccggcaccgacuucagcgacugcaucgagaccgaggagcugaacuggaacugcaccggccccuuccugaaccugggcaacugcgagaagaagcagaagaaggagagcuacagcaacaucgccgagcagcugaagggccugcaggccaucagcgugcuggacaucccccugaucgccagaauccccgaggacaucagcggcggccugagauacaucgagagcaucagaacccaccacgcccagcugaccgccgaguacgccaugcugaccagauacugcgacuaccacaagcuguucggcgacaacagcggcuacagccagaccaccuggagaauguaccugagaagccacgacuucggcgccugcauccuguaccccaaccagcacuucugcagaugcgugaagcacggcgagaagugcagcagcagcagcugggacuucgccagcgagaugaagaacuacuacagcggcaagcagggcaaguucaacaaggaccugaaccuggcccugcagagcauccaccacgccuucagaggcaccagcagcagcuacaucgccaccauccugagcgagaagagaaacgaccagcugguggaguacauggagaagcugagagagaaguucaucggcaacgcccugcugagagccgugcuggacuucaucaccuacaugaagagccugaccgagaugaccaacuucaagcacgacgaguucugggacgaguucgugcaccugcccgcccccaccaaggcccccagcaugagaagaagcggcaacgagaacuacgacuucaaggcccccaccagccccgccggcaccaagagcugcaagaacaucaagaacguggugugccugagccccagaagcggcgccagcuacgagggcaucguggccugcggcgagcccagcgccccccagaucuucaagaugcccagcgagagcaucuaccacaacaacgccgaccagagcauguacugcaucgccgacacccacugccugcaggacuacagccccguggaggacgaggagcugaacgccaucaagaagagcaagugcugggagaccgaguucaccaacgccgugcccuucaagcagagcgacggcaucagaagcugcagaaugagagacagcggcaacugcaacgugaccaccaaccuguggcccgugaugcagugcgacgacggcaaguucuacuacagcgagcaccagaaggacuacgacaaggaccaggacaucggccacuucugccugagccccagaugcaacauggugagauuccccaucagcgagaagaacauccuggccugcgacuggaucgugagccaccccaacaucgacaagaucgacgugcacagccuggaggaccuggagcaguacaagaaggccaucacccagaagcugcagaccagccugagcaucuucaaguacgccaagaccaugaaccugccccacgugaagcccaucuacaaguacaucagcaucgagggcaccgagaccgccgagggcguggagaacgccuucaucgagagcgagauccccgcccuggccggcaccagcaucggcuucaaggugaacagcaaggacggcaagcacaucauggacaucaucggcuacgugaagaccgccagcuacagcagcguguacaccaagcuguacaccaccagccccaccaccggcgugaacaccaagcacgacgagcugugcaccggccccugccccaagcagaucgagcacaagaacggcuggaucaccuucagcaaggagagaaccagcagcuggggcugcgaggaguucggcugccuggccaucagcgacggcugcguguucggcagcugccaggacaucaucaaggacgagaugagcguguacagaaaggagaccgaggagaccaccaucguggagcugugccugaccuucagcgacaagaccuacugcguggagcugaaccccgugacccccaucaucaccgaccuguucgaggugcaguucaagaccguggagagcuacacccugcccagaaucguggccgugaagaaccacgaggugauggugggccagaucaacgaccugggcguguacagcaagggcugcggcaacgugcagaaggugaacggcaccguguacggcaacggcgugcccaaguucgacuaccugugccaccuggccagcagaaaggaggugaucaucagaaagugcuucgacaacgacuaccaggccugcaaguuccugcagagccccagcagcuacagacuggaggaggacgccagcaccgugagcaucaucgacuacaagaagauccugggcaccaucaagaugaaggccauccugggcgacgugagauacaagaccuucagcgagagcaucgacaucagcgccgagggcaccugcaccggcugcgugaacugcuucgagaacauccacugcgaguucaccauccacagcaccguggaggccagcugccccguggugagcaccugcacccuguuccacgacagaauccugaucggccccgacaaccacaaguacgccaugaaggugaucugcaccgaggcccccaagaccagccugagcuucaagaucugcaacaccaagguggacgccgccaucaccaucguggacagcaagcccaucguggagcuggcccccguggaccagaccgccuacaucagagagaaggacgacagaugcaagaccuggaugugcagagugagagacgagggcaugcaggugcugagcgagcccuucaagaaccuguucggcagcuacaucggcaucuucuacaccggccuggccgugcugaucaucgcccugaucgccguguacaucgugaugcccaucugcuucaaggugaaggacauccugaagaagcacgacgacgccuacagaagagagcugaagaucagauga

SEQ ID NO: 9319 - RNA, 4326 nt, Artificial Sequence
  derived and/or modified CDS sequence (opt4) from SAV(20230)__KX817331.1__GP
augaucccccugcuguuccuggugacccuggugagcgccggccccguguuccagagaugcuuccaggacggcgccaucgugaagcagaaccccagcaaggaggccgugaccgaggugugcaucaaggacgacgugagcaugaucaagaccgaggccagauacgugagaaacagcagcggcguguucagcaacaacguggcccugagaaaguggcuggugagcgacuggcacgacugcaagcccaagaaggugagcggcggccacaucaacgugaucgaggugggcaacgaccugacccugcacaccgagagcuacgugugcagcgccgacugcaccaucggcaucgacaaggagaccgcccagaucagacugcagaccgacaccaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcauggccaacagcaucugccagaacaucgagaucaucauccugaccacccuggcccugcugaucuuccugcugcugaccauccugagcaagaccuacaucugcuaccugcugaugcccaucuucauccccaucgccuaccuguacggccugaucuacaacaagagcugcaagaagugccagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacggccugaccaucggcgacagcaaggagguguucaaccuggacgagcugcccgacgacaugcuggagauggcccagaagcugaacauguaccagcugaucugcaucaucaacuacaccgccaccuggagcaucaucaucaucggccuggccguguucuacaucuucaagaaguaccagcacagauucuacaacuacuacgccauguacugccaggagugcgacauguaccacgagagaagcggccugaaguggaacggcgacuucaccaacaagugcagacagugcaccugcggcgaguacgaggacgccgccggccugaucagccacaagaagagcuacaacugccugcugcaguacaaggugaagugggugaugaacuuccugaccaucuacguggcccugaucauccugaaggacagcacccugaucgugcaggccgccggcaccgacuucagcgacugcaucgagaccgaggagcugaacuggaacugcaccggccccuuccugaaccugggcaacugcgagaagaagcagaagaaggagagcuacagcaacaucgccgagcagcugaagggccugcaggccaucagcgugcuggacaucccccugaucgccagaauccccgaggacaucagcggcggccugagauacaucgagagcaucagaacccaccacgcccagcugaccgccgaguacgccaugcugaccagauacugcgacuacuacaagcuguucggcgacaacagcggcuacagccagaccaccuggagaauguaccugagaagccacgacuucgaggccugcauccuguaccccaacagacacuucugcagaugcgugaagcacggcgagaagugcagcagcagcagcugggacuucgccagcgagaugaagaacuacuacagcggcaagcagggcaaguucaacaaggaccugaaccuggcccugcagagcauccaccacgccuucagaggcaccagcagcagcuacaucgccaccauccugagcgagaagagaaacgaccagcugguggaguacaugaagaagcugagagagaaguucaucggcaacgcccugcugagagccgugcuggacuucaucaccuacaugaagagccugaccgagaugaccaacuucaagcacgacgaguucugggacgaguucgugcaccugcccgcccccaccaaggcccccagcaugagaagaagcggcaacgagaacuacgacuucaaggcccccaccagccccgccggcaccaagagcugcaagaacaucaagaacguggugugccugagccccagaagcggcgccagcuacgagggcaucguggccugcggcgagcccagcgccccccagaucuucaagaugcccagcgagagcaucuaccacaacaacgccgaccagagcauguacugcaucgccgacacccacugccugcaggacuacagccccguggaggacgaggagcugaacgccaucaagaagagcaagugcugggagaccgaguucaccaacgccgugcccuucaagcagagcgacggcaucagaagcugcagaaugagagacagcggcaacugcaacgugaccaccaaccuguggcccgugaugcagugcgacgacggcaaguucuacuacagcgagcaccagaaggacuacgacaaggaccaggacaucggccacuucugccugagccccagaugcaacauggugagauuccccaucagcgagaagaacauccuggccugcgacuggaucgugagccaccccaacaucgacaagaucgacgugcacagccuggaggaccuggagcaguacaagaaggccaucacccagaagcugcagaccagccugagcaucuucaaguacgccaagaccaugaaccugccccacaucaagcccaucuacaaguacaucagcaucgagggcaccgagaccgccgagggcguggagaacgccuucaucgagagcgagauccccgcccuggccggcaccagcaucggcuucaaggugaacagcaaggacggcaagcacaucauggacaucaucggcuacgugaagaccgccagcuacagcagcguguacaccaagcuguacaccaccggccccaccaccggcgugaacaccaagcacgacgagcugugcaccggccccugccccaagcagaucgagcacaagaacggcuggaucaccuucagcaaggagagaaccagcagcuggggcugcgaggaguucggcugccuggccaucagcgacggcugcguguucggcagcugccaggacaucaucaaggacgagaugagcguguacagaaaggagaccgaggagaccaccaucguggagcugugccugaccuucagcgacaagaccuacugcguggagcugaaccccgugacccccaucaucaccgaccuguucgaggugcaguucaagaccguggagagcuacacccugcccagaaucguggccgugaagaaccacgaggugauggugggccagaucaacgaccugggcguguacagcaagggcugcggcaacgugcagaaggugaacggcaccguguacggcaacggcgugcccaaguucgacuaccugugccaccuggccagcagaaaggaggugaucaucagaaagugcuucgacaacgacuaccaggccugcaaguuccugcagagccccagcagcuacagacuggaggaggacgccagcaccgugagcaucaucgacuacaagaagauccugggcaccaucaagaugaaggccauccugggcgacgugagauacaagaccuucagcgagagcaucgacaucagcgccgagggcaccugcaccggcugcgugaacugcuucgagaacauccacugcgaguucaccauccacagcaccguggaggccagcugccccguggugagcaccugcacccuguuccacgacagaauccugaucggccccgacaaccacaaguacgccaugaaggugaucugcaccgaggcccccaagaccagccugagcuucaagaucugcaacaccaagguggacgccgccaucaccaucguggacagcaagcccaucguggagcuggcccccguggaccagaccgccuacaucagagagaaggacgacagaugcaagaccuggaugugcagagugagagacgagggcaugcaggugcugcuggagcccuucaagaaccuguucggcagcuacaucggcaucuucuacaccggccuggccgugcugaucaucgcccugaucgccguguacaucgugaugcccaucugcuucaaggugaaggacauccugaagaagcacgacgacgccuacagaagagagcugaagaucagauga

SEQ ID NO: 9320 - RNA, 4329 nt, Artificial Sequence
  derived and/or modified CDS sequence (opt4) from SDNV__AF123490.1__GP
augaucugcauccugcugcugaucgcccuggccagcgccagccccguguaccagagaugcuuccaggacggcgccaucgugaagcaguaccccgccaaggacgccgugaccgaggugugccugaaggacgacgugagcaugaucaagacccaggccaacuacaugaagaacaccaccggcaccuucagcaacaacguggccaugagaaaguggcugguggccgacuggcacgacugcagaccccagaagagcagcggcggccacaucaacgugaucgaggugggcgacgaccugagccugcacaccgaggccuacaucugcagcgccgacugcgugaucagcaucgacaaggagaccgcccagaucagacugcagaccgacagcaccaaccacuucgaggugagcggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcauggccaacagcaucugccagaacaucgagaucaucauccuggugacccugacccugaugaucuucauccugcugaccaucaucagcaagaccuacaucugcuacauccugaugcccaucuucauccccaucgccuacaucuacggcuggaucuacaacaagagcugcaagaagugcaagcugugcggccugguguaccaccccuucaccgagugcggcacccacugcgugugcggcgccagauacgagaccagcgacagaaugaagcugcacagaagcagcggccugugccccggcuacaagagccugagagccgccagagugaugugcaagagcagaggccccgccagcauccugagcauccugaccgccgugcugauccugaccuucgugacccccaugagcgcccuggugaucggcagcagcgaggagcuguacaagcuggacgagcugcccgacgacaugaucgacauggccgagaaggugaaccuguacuaccuggugaucgugcugaacuacagcgccaccuggggccugcugcugcugaugggcauccuggcccugcuguucaagaaguaccagcacaucuuccugaacuacuacgccauguacugcaccgagugcgacauguaccacgacaagaaggagcugaccuacaacggcgacagccccaccaacgccuggcagugcaccugcggccaguacgaggacgccaccggccugaucgugcaccagaagagcuacaacugccuggugaaguacaaggugaaguggaucaagaacauccugaucauguacaucgugcugacccugaucaaggacagcgugcugaucgccagcgccgagggccccgacuucgccaccugcaucgaggagaagaccaucaccuggaacugcaccggccccuuccugaaccugggcagaugcgacaagacccagaagaagaccgacuacgccaccaucgccagccagcugaagggcaucgacgccaucagcauccuggacgugcccaugaucagcaagauccccgaggacaucagcggcgcccugaaguacaucgagagccugaagaccuaccacgagcagcugaccgccgaguacgccauguucaccagauacugcgacuacuacacccaguucagcgacaacagcggcuacagccagaccaccuggagaaccuaccugagaagccacgacuucgaggugugcaucgccuaccccaaccagcacuucugcagaugcgugaagaacggcgagaagugcagcagcgcccagugggacuucgccaccgagaucaagggcuacuacaccggcagacagaacaaguucaacaaggaccugaaccuggcccugaugaccuuccacaccgccuucagaggcaccgccaccagcuacgugaccgagcugaucagcaagggcaagaacagcagccugcugauguacgccagcgccaucaagagcaaguucaacggcaacgcccugcugaaggcccugcuggacuucaugauguaccugcagagccugggcgagaucagcggcuucaagcugaccgacgagugggaggacuucaaguacgaggaggagcccaccgagcagacccugaugcccagaggccacagaggcggccaguacaacuucaagaacgccgccagcaacggcaagaccaaggugugcaagaacgugaagaaggugcugugccugagccccagaagcagagccaccuucgacgacgugaucgccugcggcgagcacgccaaccccagcguguacaugauccccaacaccaccaucuaccagagcaacaccgagagaagccacuacugcaucgccgacagccacugccuggaggaguacgagcuggugaagcccgagcugcugaccgcccugaagaagagcagaugcugggccggcgacaucgacaccaucgugcugcacaagcagagcgacggccugagaagcugcagaaucaaggacaccggcagcugcaacgugaugggcaacgacuggaccaucgugcugugcgaggacaacaaguacuacuacagcgaggugcaccaggacuacgacaaggaccaggacgugggccacuucugccugagccccagaugcaacaccaucagauaccccaucagccccagacacaucaacagcugcaaguggcagaucagccacagcaccaucggcaagaucagcgugcacgagcuggccgacaucgagcaguacaagaaggccaucagccagaagcugcagaccagccugagcaucuucaaguacgccaagaccaagaaccugccccacaucaagcccguguacaaguacaucgccaucgagggcaccgagaccguggagggcguggagaacgccuucaucgagagcgagauccccgcccuggccggcaccgccaucggcuucaagaucaacagcaaggagggcuaccaccugauggacaucaucggcuacgugaagagcgccagcuacagcagcaccuacaccaagcuguacaccaccggccccaccaucggcaucaacaccaagcacgacgagaagugcaccggcagcugccccggcaccauccaccacaagaccggcuggcugaccuucagcaaggagagaaccagcaccuggggcugcgaggaguucggcugccuggccgugagcgacggcugcguguacggcagcugccaggacaucaucaaggacgagcugaccguguacagaaagaucagcgacgaggugaccgagguggagcugugccugaccuucagcgacaagaccuacugcaccaaccugaacgccgugacccccaucaucaccgacaaguucgaggugcaguucaagaccguggagagcuacagccugcccagaaucgugggcgugagaaaccacaagauccagaucggccagaucaacgacaucggcguguacagcaagggcugcggcaacgugcagaaggugaacggcaccaacuacggcaacggcgugcccaaguucgacuaccugugccaccuggccagcagaaaggaggugaucaucagaaagugcuucgacaacgacuaccaggccugcaaguuccugcagacccccgccagcuacagacuggaggagcaccagggcaccgugaccaucaucaacuacaagaagauccugggcagcaucaagaugaagcccuacugggugaugcugagauacaagaacuacgccaacagccuggacaucaacgccgagggcaccugcagcggcugcgugggcugcuucgagaacauccacugcgaguucaccauccacaccaccaucgaggccagcugccagaucgagagcgacugcaccaccuuccacgacagaauccuggugacccccaacgagcacaaguacgcccugaaggugaucugccacgacaagcccaagaccaucuucaacuucaagaucugcaacaccgagaucgaggccgccaucgccaucguggacgccaagcccaucaucgagcuggcccccguggaccagaccgccuacaucagagagaaggacgagagaugcaagaccuggaugugcagagugagagacgagggcauccaggugcugcuggagcccuucaagaaccuguucggcagcuacaucggcaucuucuacaccauccugaucgugaucuucauccuggugaucaucaucuacaucauccugcccaucugcuucaagcugcaggacacccugaagcagcacgaggacgccuacaagagagagaugaagaucagauga

SEQ ID NO: 9321 - RNA, 4329 nt, Artificial Sequence
  derived and/or modified CDS sequence (opt4) from SDNV(BeAr103645)__KX817334.1__GP
augaucugcauccugcugcugaucgcccuggccagcgccagccccguguaccagagaugcuuccaggacggcgccaucgugaagcaguaccccgccaaggacgccgugaccgaggugugccugaaggacgacgugagcaugaucaagacccaggccaacuacaugaagaacaccaccggcaccuucagcaacaacguggccaugagaaaguggcugguggccgacuggcacgacugcagaccccagaagagcagcggcggccacaucaacgugaucgaggugggcgacgaccugagccugcacaccgaggccuacaucugcagcgccgacugcgugaucagcaucgacaaggagaccgcccagaucagacugcagaccgacagcaccaaccacuucgaggugagcggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcauggccaacagcaucugccagaacaucgagaucaucauccuggugacccugacccugaugaucuucauccugcugaccaucaucagcaagaccuacaucugcuacauccugaugcccaucuucauccccaucgccuacaucuacggcuggaucuacaacaagagcugcaagaagugcaagcugugcggccugguguaccaccccuucaccgagugcggcacccacugcgugugcggcgccagauacgagaccagcgacagaaugaagcugcacagaagcagcggccugugccccggcuacaagagccugagagccgccagagugaugugcaagagcagaggccccgccagcauccugagcauccugaccgccgugcugauccugaccuucgugacccccaugagcgcccuggugaucggcagcagcgaggagcuguacaagcuggacgagcugcccgacgacaugaucgacauggccgagaaggugaaccuguacuaccuggugaucgugcugaacuacagcgccaccuggggccugcugcugcugaugggcauccuggcccugcuguucaagaaguaccagcacaucuuccugaacuacuacgccauguacugcaccgagugcgacauguaccacgacaagaaggagcugaccuacaacggcgacuucaccaacaagugcagacagugcaccugcggccaguacgaggacgccaccggccugaucgugcaccagaagagcuacaacugccuggugaaguacaaggugaaguggaucaagaacauccugaucauguacaucauccugacccugaucaaggacagcgugcugaucgccagcgccgagggccccgacuucgccaccugcaucgaggagaagaccaucaccuggaacugcaccggccccuuccugaaccugggcagaugcgacaagacccagaagaagaccgacuacgccaccaucgccagccagcugaagggcaucgacgccaucagcauccuggacgugcccaugaucagcaagauccccgaggacaucagcggcgcccugaaguacaucgagagccugaagaccuaccacgagcagcugaccgccgaguacgccauguucaccagauacugcgacuacuacacccaguucagcgacaacagcggcuacagccagaccaccuggagaaccuaccugagaagccacgacuucgaggugugcaucgccuaccccaaccagcacuucugcagaugcgugaagaacggcgagaagugcagcagcgcccagugggacuucgccaccgagaucaagggcuacuacaccggcaagcagaacaaguucaacaaggaccugaaccuggcccugaugaccuuccacaccgccuucagaggcaccgccaccagcuacgugaccgagcugaucagcaagggcaagaacagcagccugcugauguacgccagcgccaucaagagcaaguucaacggcaacgcccugcugaaggcccugcuggacuucaugauguaccugcagagccugggcgagaucagcggcuucaagcugaccgacgagugggaggacuucaaguacgaggaggagcccaccgagcagacccugaugcccagaggccacagaggcggccaguacaacuucaagaacgccgccagcaacagcaagaccaaggugugcaagaacgugaagaaggugcugugccugagccccagaagcagagccaccuucgacgacgugaucgccugcggcgagcacgccaaccccagcguguacaugauccccaacaccaccaucuaccagagcaacaccgagagaagccacuacugcaucgccgacagccacugccuggaggaguacgagcuggugaagcccgagcugcugaccgcccugaagaagagcagaugcugggccggcgacaucgacaccaucgugcugcacaagcagagcgacggccugagaagcugcagaaucaaggacaccggcagcugcaacgugaugggcaacgacuggaccaucgugcugugcgaggacaacaaguacuacuacagcgaggugcaccaggacuacgacaaggaccaggacgugggccacuucugccugagccccagaugcaacaccaucagauaccccaucagccccagacacaucaacagcugcaaguggcagaucagccacagcaccaucggcaagaucagcgugcacgagcuggccgacaucgagcaguacaagaaggccaucagccagaagcugcagaccagccugagcaucuucaaguacgccaagaccaagaaccugccccacaucaagcccguguacaaguacaucgccaucgagggcaccgagaccguggagggcguggagaacgccuucaucgagagcgagauccccgcccuggccggcaccgccaucggcuucaagaucaacagcaaggagggcaaccaccugauggacaucaucggcuacgugaagagcgccagcuacagcagcaccuacaccaagcuguacaccaccggccccaccaucggcaucaacaccaagcacgacgagaagugcaccggcagcugccccggcaccauccaccacaagaccggcuggcugaccuucagcaaggagagaaccagcaccuggggcugcgaggaguucggcugccuggccgugagcgacggcugcguguacggcagcugccaggacaucaucaaggacgagcugaccguguacagaaagaucagcgacgaggugaccgagguggagcugugccugaccuucagcgacaagaccuacugcaccaaccugaacgccgugacccccaucaucaccgacaaguucgaggugcaguucaagaccguggagagcuacagccugcccagaaucgugggcgugagaaaccacaagauccagaucggccagaucaacgacaucggcguguacagcaagggcugcggcaacgugcagaaggugaacggcaccaacuacggcaacggcgugcccaaguucgacuaccugugccaccuggccagcagaaaggaggugaucaucagaaagugcuucgacaacgacuaccaggccugcaaguuccugcagacccccgccagcuacagacuggaggagcaccagggcaccgugaccaucaucgacuacaagaagauccugggcagcaucaagaugaaggccauccugggcgacgugagauacaagaacuacgccaacagccuggacaucaacgccgagggcaccugcgccggcugcgugggcugcuucgagaacauccacugcgaguucaccauccacaccaccaucgaggccagcugccagaucgagagcgacugcaccaccuuccacgacagaauccuggugacccccaacgagcacaaguacgcccugaaggugaucugccacgacaagcccaagaccauccugaacuucaagaucugcaacaccaagaucgaggccgccaucaccaucguggacgccaagcccaucaucgagcuggcccccguggaccagaccgccuacaucagagagaaggacgagagaugcaagaccuggaugugcagagugagagacgagggcauccaggugcugcuggagcccuucaagaaccuguucggcagcuacaucggcaucuucuacaccauccugaucgugaucuucauccuggugaucaucaucuacaucauccugcccaucugcuucaagcugcaggacacccugaagcagcacgaggacgccuacaagagagagaugaagaucagauga

SEQ ID NO: 9322 - RNA, 4326 nt, Artificial Sequence
  derived and/or modified CDS sequence (opt4) from SSHV__EU262553.1__GP
augaucugcauccugauccuguucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucaagaacgccaccggcguguucagcaacaacguggccaucagaaaguggcuggugagcgacuggcacgacugcagacccaagaagaucaccggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcgugcugagcaagaccuacaucugcuaccugcugaugcccguguucauccccaucgccuacgccuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcgugaucaccgccauccugauccugaccuucgugacccccaucaacagcaugguggugggcgagagcaaggagguguucgagcuggagcagcugcccgacgacaugcuggacauggcccugagaaucaacuucuacuacuucgugugcaucaugaacuacgccgugaccuggggccugaucaucaucggccugcugaucggccugcuguucaagaaguaccagcacagauucagcaaccuguacgccauguacugcgaggagugcgacauguaccacgacagaagcggccugaagagaaacggcgacuucaccaacaagugcagacagugcaccugcggccaguacgaggacgccaccggccugaugacccacagaaagaccuacaacugccuggugagauacaaggccaagugggugaugaacuuccugaucgccuacaugcugcugacccugaucaaggacagcgccaucguggugcaggccgccggcaccgacuucaccaccugccuggagaccgagaacaucaacuggaacugcaccggccccuuccugaaccugggcaacugccagaagcagcagaagaaggagcccuacgccaacaucgccacccagcugaagggccugcaggccaucagcgugcuggacaugcccaugaucgccagcauccccgaggacaucgccggcgcccugagauacaucgaggagaaggagaccuuccacgugcagcugaccgccgaguacgccaugcugagcagauacugcgacuacuacgcccaguucagcgacaacagcggcuacagccagaccaccuggagaguguaccugagaagccacgacuucgacgccugcauccuguaccccaaccagcacuucugcagaugcgugaagcacggcgacaagugcagcagcagcaacagagacuucgccaacgagaugaagaacuacuacagcggcaagcagaacaaguucgacaaggaccugaaccuggcccugauggcccugcaccacgccuucagaggcaccagcagcgccuacaucgccaccaugcugagcaagaagagcaacgacgaccugaucgccuacaccaacaagaucaaggagaaguuccccggcaacgcccugcugaaggccaucguggacuacaucgccuacaugaagagccugagcgagaugagcagcuucaaguacgacgaguucugggacgaccugcuguacaagagcgcccccaccaaggcccccagccugagcagaggcagcgagcccagcuacaacuucaagcugguggugagcagcagaagcaucaagagcugcaagaacgugaagagcguggugugccugagccccagaagcggcgugagcuacgacagcaucaucgccugcggcgaccccaacggccccagcguguacagaaagcccagcgacggcguguuccagagcaacgccgaccagagcaccuacugccuggccgacagccacugccuggaggacuucgagguggugagccaggaggagcuggacgccaucaagaagagcaagugcugggaggccgaguaccccgacgugaagcugagcaagcugaccgacggcgugaagagcugcagaaugaaggacagcggcaacugcaacguggccgccaacagauggcccaucauccagugcgagaacgacaaguucuacuacagcgagcugcagaaggacuacgacaagacccaggacaucggccacuucugccugagccccggcugcagcaccgugagauuccccaucaaccccaagcacaucagcaacugcaacuggcaggugagcagaagcagcaucgccaagaucgacgugcacaacaucgaggacaucgaccaguacagaaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaccagcaaggagggcaagcaccugcuggacgugaucggcuacgugaagagcgccagcuacagcagcaucuacaccaagcuguacaccaccggccccaccagcggcaucaacaccaagcacgacgagcugugcaccggccccugccccgccaagaucaaccaccagaccggcuggcugaccuucgccaaggagagaaccagcagcuggggcugcgaggaguucggcugccuggccaucagcgacggcugcguguucggcagcugccaggacaucaucagagacgagcugaccguguacagaaaggagaccgacgaggugaccgacguggagcugugccugaccuucagcgacaagaccuacugcaccaaccugaaccccaucacccccaucaucaccgaccuguucgaggugcaguucaagaccguggagaccuacagccugcccagaaucguggccauccagaaccacgagaucaagaucggccaggugaacgaccugggcguguacagcaagggcugcggcaacgugcagaaggugaacggcaccguguacggcaacggcgugcccaaguucgacuaccugugccaccuggccagcagaaaggaggugaucgugagaaagugcuucgacaacgacuaccaggccugcaaguuccugcagagccccgccagcuacagacuggaggaggacagcggcaccgugaccgugaucgacuacaagaagauccugggcaccaucaagaugaaggccauccugggcgacgugaaguacaagaccuucgccgacaacguggacaugaccgccgagggcagcugcaccggcugcaucaacugcuucgagaacauccacugcgagcugacccugcacaccaccaucgaggccagcugccccaucgugagcaccugcaccguguuccacgacagaauccuggugacccccaacgagcacaaguacgcccugaagguggugugcaccgagaagcccggcaacacccugaccaucagaaucugcaacaccaagguggaggccagccuggcccugguggacgccaagcccauccuggagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucaucgcccugcugaucaucaucuacaucgugcugcccaucugcuucaagcugagagacacccugagaaagcacgaggacgccuacaagagagagaugaagaucagauga

SEQ ID NO: 9323 - RNA, 4326 nt, Artificial Sequence
  derived and/or modified CDS sequence (opt4) from SSHV__K02539.1__GP
augaucugcauccugauccuguucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucaagaacgccaccggcguguucagcaacaacguggccaucagaaaguggcuggugagcgacuggcacgacugcagacccaagaagaucaccggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaucgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcgugcugagcaagaccuacaucugcuaccugcugaugcccguguucauccccaucgccuacgccuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcgugaucaccgccauccugauccugaccuucgugacccccaucaacagcaugguggugggcgagagcaaggagguguucgagcuggagcagcugcccgacgacaugcuggacauggcccugagaaucaacuucuacuacuucgugugcaucaugaacuacgccgugaccuggggccugaucaucaucggccugcugaucggccugcuguucaagaaguaccagcacagauucagcaaccuguacgccauguacugcgaggagugcgacauguaccacgacagaagcggccugaagagaaacggcgacuucaccaacaagugcagacagugcaccugcggccaguacgaggacgccaccggccugaugacccacagaaagaccuacaacugccuggugagauacaaggccaagugggugaugaacuuccugaucgccuacaugcugcugacccugaucaaggacagcgccaucguggugcaggccgccggcaccgacuucaccaccugccuggagaccgagaacaucaacuggaacugcaccggccccuuccugaaccugggcaacugccagaagcagcagaagaaggagcccuacgccaacaucgccacccagcugaagggccugcaggccaucagcgugcuggacaugcccaugaucgccagcauccccgaggacaucgccggcgcccugagauacaucgaggagaaggagaccuuccacgugcagcugaccgccgaguacgccaugcugagcagauacugcgacuacuacgcccaguucagcgacaacagcggcuacagccagaccaccuggagaguguaccugagaagccacgacuucgacgccugcauccuguaccccaaccagcacuucugcagaugcgugaagagaggcgacaagugcagcagcagcaacggcgacuucgccaacgagaugaagaacuacuacagcggcaagcagaacaaguucgacaaggaccugaaccuggcccugauggcccugcaccacgccuucagaggcaccagcagcgccuacaucgccaccaugcugagcaagaagagcaacgacgaccugaucgccuacaccaacaagaucaaggagaaguuccccggcaacgcccugcugaaggccaucguggacuacaucgccuacaugaagagccugagcgagaugagcagcuucaaguacgacgaguucugggacgaccugcuguacaagagcgcccccaccaaggcccccagccugagcagaggcagcgagcccagcuacaacuucaagcugguggugagcagcagaagcaucaagagcugcaagaacgugaagagcguggugugccugagccccagaagcggcgugagcuacgacagcaucaucgccugcggcgaccccaacggccccagcguguacagaaagcccagcgacggcguguuccagagcaacgccgaccagagcaccuacugccuggccgacagccacugccuggaggacuucgagguggugagccaggaggagcuggacgccaucaagaagagcaagugcugggaggccgaguaccccgacgugaagcugagcaagcugaccgacggcgugaagagcugcagaaugaaggacagcggcaacugcaacguggccgccaacagauggcccaucauccagugcgagaacgacaaguucuacuacagcgagcugcagaaggacuacgacaagacccaggacaucggccacuucugccugagccccggcugcagcaccgugagauuccccaucaaccccaagcacaucagcaacugcaacuggcaggugagcagaagcagcaucgccaagaucgacgugcacaacaucgaggacaucgaccaguacagaaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaccagcaaggagggcaagcaccugcuggacgugaucggcuacgugaagagcgccagcugcagcagcaucuacaccaagcuguacaccaccggccccaccagcggcaucaacaccaagcacgacgagcugugcaccggccccugccccgccaagaucaaccaccagaccggcuggcugaccuucgccaaggagagaaccagcagcuggggcugcgaggaguucggcugccuggccaucagcgacggcugcguguucggcagcugccaggacaucaucagagacgagcugaccguguacagaaaggagaccgacgaggugaccgacguggagcugugccugaccuucagcgacaagaccuacugcaccaaccugaaccccaucacccccaucaucaccgaccuguucgaggugcaguucaagaccguggagaccuacagccugcccagaaucguggccauccagaaccacgagaucaagaucggccaggugaacgaccugggcguguacagcaagggcugcggcaacgugcagaaggugaacggcaccguguacggcaacggcgugcccaaguucgacuaccugugccaccuggccagcagaaaggaggugaucgugagaaagugcuucgacaacgacuaccaggccugcaaguuccugcagagccccgccagcuacagacuggaggaggacagcggcaccgugaccgugaucgacuacaagaagauccugggcaccaucaagaugaaggccauccugggcgacgugaaguacaagaccuucgccgacaacguggacaugaccgccgagggcagcugcaccggcugcaucaacugcuucgagaacauccacugcgagcugacccugcacaccaccaucgaggccagcugccccaucgugagcaccugcaccguguuccacgacagaauccuggugacccccaacgagcacaaguacgcccugaagguggugugcaccgagaagcccggcaacacccugaccaucagaaucugcaacaccaagguggaggccagccuggcccugguggacgccaagcccauccuggagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucaucgcccugcugaucaucaucuacaucgugcugcccaucugcuucaagcugagagacacccugagaaagcacgaggacgccuacaagagagagaugaagaucagauga

SEQ ID NO: 9324 - RNA, 4335 nt, Artificial Sequence
  derived and/or modified CDS sequence (opt4) from SORV__AF123488.1__GP
auggaggugcugagccugaucuggcugcugacccugugcagcgccagccccguguuccagagaugcuuccaggacggcgccaucgugaagcagaaccccagcaaggaggccgugaccgaggugugccugaaggacgacgugagcaugaucaagaccgagaccaaguacgugaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggugaucuucaucuuccugaccaucgugagcaagaccuacaucugcuaccugcugaugcccaucuucauccccaucgccuucaucuacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcauccugaccgccauccugauccugaccuucgugacccccaucagcgccaugguggugggcgagagcaacgagaucuacacccuggacgaccugcccgacgacauggugcagauggccgagagaaucaacaucuacuaccagauccugaucaucaacuacggcgugaccugggccuuccugcugcugggccuggugcuggccuacuucuucaagaaguaccagcacaaguuccuggacuacuacgccauguacugcgaggagugcgacauguaccacgagaagagcggcaugaccuacuggggcgacuucaccaacaagugcagacagugcaccugcggccaguucgaggacgccaccggccugauggugcacaagaagagcuacaacugccuggugaaguacaaggccaaguggaucagaaacauccugaucgccuaccugaugaucaugcuggugaaggacagccugcuguucgugggcgccaccagagccgacuucgccagcugcguggacgagaagaccgugaccuggaacugcaccggccccuuccugaaccugggcagaugcgacaagacccagaagaagaccggcuacaaggacaucgccaaccagcugaagggccugggcgugaucagcauccuggacauccccaugaucgagaagaugcccgacgagaucagcggcagccugaaguacaucgacagccuggagaccuaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaaguacgacgacaagugcaacagcgccaagugggacuucgccaacgagaugaagaccuucuacaccggcagaaaggugaaguucaacaaggaccugaaccuggcccugcuggugcugcacaaggccuucagaggcaccggcaccgccuacaucgccgaggccauggccagaaaggacaacggcagcauggcccacuucgcccuggagaucagaaagaaguuccccaccaacgcccugcuggccgcccugaucgacuacaucguguaccugcagagccuggccgagaucagcaccuucgagcuggaggaggacugggaggacuucaaguacaagcccgagcccaccgagagcacccugcagcccagaagccacagaagcgaccaguacaacuucaagaacgccgacagcaacagcaacgugaaggugugcaagaacgugaagaaggugcugugcgugagccccagaagcagagccaaguucgagaacaucaucgccugcggcgagcacgccaaccccagcguguacaugaugcccaacaucagcaucuaccagagcaacagcgagagaagccacuacugcaucgccgacagccacugccuggaggaguacgagaucgugaacaccgagcugcugaccgcccugaagaagagcagaugcugggccaaggagauggacgacguggugcugcacaagcagagcgacggccugagaagcugcagaaucaaggacaccggcagcugcaacgugcugggcaacgacuggaccaucgugcugugcgagaacggcaacuacuacuacagcgagauccacaaggacuacgacaaggaccaggacgugggccacuucugccugagccccagaugcagcaccaucagauaccccaucaacagaagacacaucagaaagugcgacuggcagaucagccacagcaccaucgacaagaucagcgugcaggagcuggccgacaucgagcaguacaagaaggccaucagccagaagcugcagaccagccugagcaucuucaaguacgugaagaccaagaaccugccccacaucaagcccgccuacaaguacaucaccguggagggcaccgagaccaucgagggcaucgagaacgccuucaucgagagcgagauccccgcccuggccggcaccgccaucggcuucaagaucaacagcagagagggcaacuaccugauggacgugaucggcuacgugaagagcgccagcuacagcgccaccuacaccaagcuguacaccaccggccccaccaucggcaucaacaccagacacgacgagaagugcaccggccccugccccgugaccaucgaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagaaucaucgccgugaagaaccacgagaucaaggugggccagaucaacgaccugggcguguacagcaagggcugcggcaacgugcagaaggugaacggcaccaacuacggcaacggcgugcccaaguucgacuaccugugccaccuggccagcagaaaggaggugauccugagaaagugcuucgacaacgacuaccaggccugcaaguuccugcagagccccgccagcuacagacuggaggagcaccagggcaccgugaccgugaucgacuacaagaagauccugggcagcaucaagaugaaggccauccugggcgacgugaaguacaagaacuaccagagcaacaucgagaucaacgccgagggcaccugcgccggcugcgugaacugcuucgagaacauccacugcgaguucaccauccacaccaccguggagaccagcugccccaucgugaccgacugcgugagcuuccacgacagaauccugaucacccccgacgagcacaaguacgcccugaagaucgugugccaggacaagcccaaggugagccugaaguucaagaucugcaacaccaacaucgacgccagcaugaccaucguggacagcaagcccauccuggagcuggcccccguggaccagaccgccuacaucaaggagaaggacgagagaugcaagaccuggaugugcagagugagagacgagggcuuccaggugauccuggagcccuucaagaaccuguucggcagcuacaucggcaucuucuacaccggcauccugagcgugaucugccugcugaucgugaucuacaucgugcugcccaucugcuucaagcugagagacacccugaagcagcacgaggacgccuacaagaaggagaugaagaucagauga

SEQ ID NO: 9325 - RNA, 4335 nt, Artificial Sequence
  derived and/or modified CDS sequence (opt4) from SORV(SORV-252)__JN815081.1__GP
auggaggugcugagccugaucuggcugcuggccgugugcagcgccaaccccguguuccagagaugcuuccaggacggcgccaucgugaagcagaaccccagcaaggaggccgugaccgaggugugccugaaggacgacgugagcaugaucaagaccgaggccaaguacgugaagaacaccaccggcaccuucagcaacaacguggccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacagcaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccugaucaucuucaucuuccugaccaucgugagcaagaccuacaucugcuaccugcugaugcccaucuucauccccaucgccuucaucuacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcauccugaccgccgugcugauccugaccuucgugacccccaucagcgccaucaucaucgacgagagcaaggagaucuacacccuggacgaccugcccgacgacauggugcagauggccgagagaaucaacaucuacuaccagauccugcugaucaacuacggcgugaccugggccuuccugcugcugggccugauccuggccuacuucuucaagaaguaccagcacaaguuccuggacuacuacgccauguacugcgaggagugcgacauguaccacgagaagagcggcaugaccuacuggggcgacuucaccaacaagugcagacagugcaccugcggccaguacgaggacgccgccggccugauggugcacaagaagagcuacaacugccugaucaaguacaaggccaaguggaucaagaacauccugauccuguaccugaucaugauccuggugaaggacagccugcuguucgugggcgccaccggcaccgacuucgccgccugcaucgacgagaagagcgugaccuggaacugcaccggccccuuccugaaccugggcagaugcgacaagccccagaagaaggccagcuucaaggacaucgccaaccagcugaagggccugggcgugaucagcgugcuggacauccccaugaucgagaagaugcccgacgacaucagcggcagccugaaguacaucgacagccugagaaccuaccacgagcagcugaccgccgaguacgccuuccugaccagauacugcgacuacuacgcccaguacaccgacaacagcggcuacagccagaccguguggagaaccuaccugagaagccacgacuucggcgccugcgugguguaccccaaccagcacuucugcagaugcgugaaguacggcgacaagugcaacagcgccaagugggacuucgccaacgagaugaagagcuucuacaccggccagaaggccaaguucaacaaggaccugaaccuggcccugcuggugcugcacaaggccuucagaggcaccggcaccgccuacaucgccgagacccuggccagaaaggacaacggcagcauggugcacuucgcccuggagaucagaaagaaguuccccaccaacgcccugcuggccgcccugaucgacuacaucguguaccugcagagccuggccgagaucagcaccuucgagcccgaggaggacugggaggacagcaaguaccagcccgagcccaccgagagcgugcugcagcccagagcccacagaagcgaccaguacaacuucaagaacgccgacagcaacagcaacgugaaggugugcaagaacaucaagaaggugcugugcaucagccccagaagcagagccaaguucgagaacaucaucgccugcggcgagcacgccaaccccagcguguacaugaugcccaacaccagcaucuaccagagcaacagcgagagaagccacuacugcaucgccgacagccacugccuggaggaguacgagaucgugaacaccgagcugcugaccgccuucaagaagagcagaugcugggccaaggagaucgacgacaucgugcugcacaagcagagcgacggccugagaagcugcagaaucaaggacaccggcagcugcaacgugcugggcaacgacuggaccaucgugcugugcgagaacggcaacuacuacuacagcgaggugcacaaggacuacgacaaggaccaggacgugggccacuucugccugagccccagaugcaacaccaucagauaccccaucagcagaagacacaucggcgagugcaacuggcagaucacccacagcaccaucgacaagaucagcgugcaggagcuggccgacaucgagcaguacaagaaggccaucagccagaagcugcagaccagccugagcaucuucaaguacgugaagaccaagaaccugccccacaucaagcccgccuacagauacaucaccgugggcggcaccgagaccaucgagggcguggagaacgccuucaucgagagcgagauccccgcccuggccggcaccgccaucggcuucaagaucaacagcagagagggcaacuaccugauggacgugaucggcuacgugaagagcgccagcuacagcgccaccuacaccaagcuguacaccaccggccccaccaucggcaucaacaccaagcacgacgagaagugcaccggcagcugccccgugaccaucaaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccgaccugaacgccaucacccccaucaucaccgacaaguucgaggugcaguucaagaccguggagagcuacacccugcccagaaucaucgccgugaagaaccacgagaucagaaccggccagaucaacgaccugggcguguacagcaagggcugcggcaacgugcagaaggugaacggcaccagcuacggcaacggcgugcccaaguucgacuaccugugccaccuggccagcagaaaggaggugauccugagaaagugcuucgacaacgacuaccaggccugcaaguuccugcagagccccgccagcuacagacuggaggagcaccagggcaccgugaccgugaucgacuacaagaagauccugggcagcaucaagaugaaggccaugcugggcgacgugaaguacaagaacuaccagagcaacaucgagaucaacgccgagggcaccugcgccggcugcaucgacugcuucgagaacauccacugcgaguucaccauccacaccaccguggaggccagcugccccaucaccaccgacugcgugagcuuccacgacagaauccugaucacccccgaggagcacaaguacgcccugaagaucgugugccaggacaagcccaaggugagccugaaguucaagaucugcaacaccaacguggaggccagcaugaccaucaucgacagcaagcccauccuggagcuggcccccguggaccagaccaccuacaucaaggagaaggacgagagaugcaagaccuggaugugcagagugagagacgagggcuuccaggugauccuggagcccuucaagaaccuguucggcagcuacaucggcaucuucuacaccggcgugcugagcaucaucugccugcugaucgugaucuacaucauccugcccaucugcuacaagcugagagacacccugaagcagcacgaggacgccuacaagaaggagaugaagaucagauga

SEQ ID NO: 9326 - RNA, 4335 nt, Artificial Sequence
  derived and/or modified CDS sequence (opt4) from SORV(NJO-94F)__KX817337.1__GP
auggaggugcugagccugaucuggcugcugacccugugcagcgccagccccguguuccagagaugcuuccaggacggcgccaucgugaagcagaaccccagcaaggaggccgugaccgaggugugccugaaggacgacgugagcaugaucaagaccgagaccaaguacgugaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggugaucuucaucuuccugaccaucgugagcaagaccuacaucugcuaccugcugaugcccaucuucauccccaucgccuucaucuacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcauccugaccgccauccugauccugaccuucgugacccccaucagcgccaugguggugggcgagagcaacgagaucuacacccuggacgaccugcccgacgacauggugcagauggccgagagaaucaacaucuacuaccagauccugaucaucaacuacggcgugaccugggccuuccugcugcugggccuggugcuggccuacuucuucaagaaguaccagcacaaguuccuggacuacuacgccauguacugcgaggagugcgacauguaccacgagaagagcggcaugaccuacuggggcgacuucaccaacaagugcagacagugcaccugcggccaguucgaggacgccaccggccugauggugcacaagaagagcuacaacugccuggugaaguacaaggccaaguggaucagaaacauccugaucgccuaccugaugaucaugcuggugaaggacagccugcuguucgugggcgccaccagagccgacuucgccagcugcguggacgagaagaccgugaccuggaacugcaccggccccuuccugaaccugggcagaugcgacaagacccagaagaagaccggcuacaaggacaucgccaaccagcugaagggccugggcgugaucagcauccuggacauccccaugaucgagaagaugcccgacgagaucagcggcagccugaaguacaucgacagccuggagaccuaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaaguacggcgacaagugcaacagcgccaagugggacuucgccaacgagaugaagaccuucuacaccggcagaaaggugaaguucaacaaggaccugaaccuggcccugcuggugcugcacaaggccuucagaggcaccggcaccgccuacaucgccgaggccauggccagaaaggacaacggcagcauggcccacuucgcccuggagaucagaaagaaguuccccaccaacgcccugcuggccgcccugaucgacuacaucguguaccugcagagccuggccgagaucagcaccuucgagcuggaggaggacugggaggacuucaaguacaagcccgagcccaccgagagcacccugcagcccagaagccacagaagcgaccaguacaacuucaagaacgccgacagcaacagcaacgugaaggugugcaagaacgugaagaaggugcugugcgugagccccagaagcagagccaaguucgagaacaucaucgccugcggcgagcacgccaaccccagcguguacaugaugcccaacaucagcaucuaccagagcaacagcgagagaagccacuacugcaucgccgacagccacugccuggaggaguacgagaucgugaacaccgagcugcugaccgcccugaagaagagcagaugcugggccaaggagauggacgacguggugcugcacaagcagagcgacggccugagaagcugcagaaucaaggacaccggcagcugcaacgugcugggcaacgacuggaccaucgugcugugcgagaacggcaacuacuacuacagcgagauccacaaggacuacgacaaggaccaggacgugggccacuucugccugagccccagaugcagcaccaucagauaccccaucaacagaagacacaucagaaagugcgacuggcagaucagccacagcaccaucgacaagaucagcgugcaggagcuggccgacaucgagcaguacaagaaggccaucagccagaagcugcagaccagccugagcaucuucaaguacgugaagaccaagaaccugccccacaucaagcccgccuacaaguacaucaccguggagggcaccgagaccaucgagggcaucgagaacgccuucaucgagagcgagauccccgcccuggccggcaccgccaucggcuucaagaucaacagcagagagggcaacuaccugauggacgugaucggcuacgugaagagcgccagcuacagcgccaccuacaccaagcuguacaccaccggccccaccaucggcaucaacaccagacacgacgagaagugcaccggccccugccccgugaccaucgaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagaaucaucgccgugaagaaccacgagaucaaggugggccagaucaacgaccugggcguguacagcaagggcugcggcaacgugcagaaggugaacggcaccaacuacggcaacggcgugcccaaguucgacuaccugugccaccuggccagcagaaaggaggugauccugagaaagugcuucgacaacgacuaccaggccugcaaguuccugcagagccccgccagcuacagacuggaggagcaccagggcaccgugaccgugaucgacuacaagaagauccugggcagcaucaagaugaaggccauccugggcgacgugaaguacaagaacuaccagagcaacaucgagaucaacgccgagggcaccugcgccggcugcgugaacugcuucgagaacauccacugcgaguucaccauccacaccaccguggagaccagcugccccaucgugaccgacugcgugagcuuccacgacagaauccugaucacccccgacgagcacaaguacgcccugaagaucgugugccaggacaagcccaaggugagccugaaguucaagaucugcaacaccaacaucgacgccagcaugaccaucguggacagcaagcccauccuggagcuggcccccguggaccagaccgccuacaucaaggagaaggacgagagaugcaagaccuggaugugcagagugagagacgagggcuuccaggugauccuggagcccuucaagaaccuguucggcagcuacaucggcaucuucuacaccggcauccugagcgugaucugccugcugaucgugaucuacaucgugcugcccaucugcuucaagcugagagacacccugaagcagcacgaggacgccuacaagaaggagaugaagaucagauga

SEQ ID NO: 9327 - RNA, 4323 nt, Artificial Sequence
  derived and/or modified CDS sequence (opt4) from TAHV__AF123485.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgagguggacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucaaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacauggaggaccugaccgagaugaacaacuucaagcacgacgagaugugggacgacuucaucuucgaggugccccccaccaagagccccagcaucagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggccuggagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9328 - RNA, 4323 nt, Artificial Sequence
  derived and/or modified CDS sequence (opt4) from TAHV__AF229129.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacggcgacgccgccggccugcugacccacagaaagaccuacaacugccuggugcaguacaagagcaaguggcugaccaacuuccugaucggcuacaucauccugaugcugaucaaggacagcgugcugcuggugcacgccgacggcaccgacuucgagaagugcagcggcgaggccgacaucaccuggaacugcaccggccccuuccugagccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaacagacacuucugcagaugcgugaagcacggcgacaagugcagcagcagcaacugggacuucgccaacgagaugaagaacuacuacagcggcaagcagagcaaguucaacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaagggccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacacccagcugaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugaaccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgcccccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcgugaacugcuucgagaacauccacugcgagagcaccauccacagcaccguggaggccagcugccccgugaucagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaagguggagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9329 - RNA, 4323 nt, Artificial Sequence
  derived and/or modified CDS sequence (opt4) from TAHV(22595-6)__HM036218.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccacccugagaguguaccugagaagccacgacuucaaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacauggaggaccugaccgagaugaacaacuucaagcacgacgagaugugggacgacuucaucuucgaggugccccccaccaagagccccagcaucagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcgagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9330 - RNA, 4323 nt, Artificial Sequence
  derived and/or modified CDS sequence (opt4) from TAHV(92' Bardos)__HM036209.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacaacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacgaggacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacaucagcaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuucuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacauggaggaccugaccgagaugaacaacuucaaguacgacgagaugugggacgacuucaucuucgaggugccccccaccaagagccccagcaucagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9331 - RNA, 4323 nt, Artificial Sequence
  derived and/or modified CDS sequence (opt4) from TAHV(92' Bardos)__HM036212.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccaucaagcuggaggaccugcccgacgacaugcugagcaccgccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacgaggacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacaucagcaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucaaggccugcauccuguaccccaaccagcacuucugcagaugcgugaagcacggcgacaagugcagcagcagcaacugggacagcgccaacgagaugaagaacuucuacagcggcaaccagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacauggaggaccugaccgagaugaacaacuucaaguacgacgagaugugggacgacuucaucuucgaggugccccccaccaagagccccagcaucagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9332 - RNA, 4323 nt, Artificial Sequence
  derived and/or modified CDS sequence (opt4) from TAHV(Souche D C14019-29)__HM036215.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucaagaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucgaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaacagacacuucugcagaugcgugaagcacggcgacaagugcagcagcagcaacugggacuucgccaacgagaugaagaacuacuacagcggcaagcagagcaaguucaacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaaggaccugaccgagaugaacaacuucaagcacgacgagaugugggaggacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccguggccaccaacagauggcccaucauccugugcgacaacaacaaguucuacuacagcgagcugcaggaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccauccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagaucagagacacccugagacagcacgaggacgccuacaagagagagaugaagaucagauga

SEQ ID NO: 9333 - RNA, 4323 nt, Artificial Sequence
  derived and/or modified CDS sequence (opt4) from TAHV(1014)__GQ386833.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggcaaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugagagagaagaagaacgaggaccuggugaccuacguggagaagaucaagggcaaguaccccggcaacgcccugcugaaggccaucaucgacuacaucaaguacaugaagggccugaccgagaugaacaacagcaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuucgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaagggccaggacaucggccacuucugccugagccccagaugcaacaccaucagacaccccaucaacagaaagcacaucagcaacugcaccuggcaggugaaccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcaucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9334 - RNA, 4323 nt, Artificial Sequence
  derived and/or modified CDS sequence (opt4) from TAHV(105)__GQ386829.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9335 - RNA, 4323 nt, Artificial Sequence
  derived and/or modified CDS sequence (opt4) from TAHV(106)__GQ386830.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaagggccugaccgagaugaacaacuucaagcacgacgagaugugggacgacuucaucagcgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucgacgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9336 - RNA, 4323 nt, Artificial Sequence
  derived and/or modified CDS sequence (opt4) from TAHV(181)__GQ386831.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacggcgacgccgccggccugcugacccacagaaagaccuacaacugccuggugcaguacaagagcaaguggcugaccaacuuccugaucggcuacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaacagacacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaagggccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugaaccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9337 - RNA, 4323 nt, Artificial Sequence
  derived and/or modified CDS sequence (opt4) from TAHV(236)__GQ386832.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccaucaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacaugcccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccgugaucugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgagcugaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcagcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacgcccugagacagcacgaggacgccuacaagagagagaugaagaucagauga

SEQ ID NO: 9338 - RNA, 4323 nt, Artificial Sequence
  derived and/or modified CDS sequence (opt4) from TAHV(29)__GQ386823.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacgacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacaugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacguggccaugacccuggccgacgccaagcccauccuggagcuggcccccguggaccagaccaccuacaucaaggagaaggacgagagaugcaagaccuggaugugcagagugaaggacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9339 - RNA, 4323 nt, Artificial Sequence
  derived and/or modified CDS sequence (opt4) from TAHV(4019)__GQ386834.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaacagacacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacagcaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgaggccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucagcuacgugaagagcgccagcuacagcgccguguacaccaagcuguacaccaccggccccaccaucggcgugaacaccaagcacgacgagcugugcaccggccccugccccgugaacgugccccacggcaccggcuggaucaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9340 - RNA, 4323 nt, Artificial Sequence
  derived and/or modified CDS sequence (opt4) from TAHV(4020)__GQ386835.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguacagcggcaacgcccugcugaaggccaucaucgacuacaucaaguacaugaagggccugaccgagaugaacaacuucaagcacgacgagaugugggacgacuucaucuucgaggugcccccccccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9341 - RNA, 4323 nt, Artificial Sequence
  derived and/or modified CDS sequence (opt4) from TAHV(4030)__GQ386836.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugcaacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccugaucaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaucguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcgugaacugcuucgagaacauccacugcgagcugaccauccacagcaccguggaggccagcugcagcguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9342 - RNA, 4323 nt, Artificial Sequence
  derived and/or modified CDS sequence (opt4) from TAHV(4033)__GQ386837.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacggcuuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugagccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9343 - RNA, 4323 nt, Artificial Sequence
  derived and/or modified CDS sequence (opt4) from TAHV(4034)__GQ386838.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacacccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcauccugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagaugcugcgacuacuacacccaguucaccgacaacagcggcuacagccagaccaccuggagaguguaccugagaagccacgacuucgaggccugcauccuguaccccaaccagcacuucugcagaugcgugaagcacggcaacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacaccgaccagacccacuucugccugagcgacacccacugccuggagaacuacgaggccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugaaccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagauccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9344 - RNA, 4323 nt, Artificial Sequence
  derived and/or modified CDS sequence (opt4) from TAHV(4057)__GQ386839.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaagggcagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaucaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacggcgaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacaaguggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcagacaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcgugaacugcuucgagaacauccacugcgagagcaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9345 - RNA, 4323 nt, Artificial Sequence
  derived and/or modified CDS sequence (opt4) from TAHV(4060)__GQ386840.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccauccugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcagacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacacccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugaucgccaucuucaucgugaucuacaucgugcugcccaucugcuucaagcugagagacacccugagacagcacgaggacgccuacaagagagagaugaagaucagauga

SEQ ID NO: 9346 - RNA, 4323 nt, Artificial Sequence
  derived and/or modified CDS sequence (opt4) from TAHV(5060)__GQ386841.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaucaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacggcgaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugagccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacaaguggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacagcaacaucgacaagaucgaggugcacgagcuggaggaccuggagcaguacaagaaggccaucacccagaagcugcagaccagccugacccuguucaaguacagcaagaccaagaaccugccccacaucaagcccaucuacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9347 - RNA, 4323 nt, Artificial Sequence
  derived and/or modified CDS sequence (opt4) from TAHV(76)__GQ386824.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacggcgacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgaggccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucagcuacgugaagagcgccagcuacagcgccguguacaccaagcuguacaccaccggccccaccaucggcgugaacaccaagcacgacgagcugugcaccggccccugccccgugaacgugccccacggcaccggcuggaucaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9348 - RNA, 4323 nt, Artificial Sequence
  derived and/or modified CDS sequence (opt4) from TAHV(83)__GQ386825.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggugugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaagggccugaccgagaugaacaacuucaagcacgacgaggugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9349 - RNA, 4323 nt, Artificial Sequence
  derived and/or modified CDS sequence (opt4) from TAHV(89)__GQ386826.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucggcuacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaagggccugaccgagaugaacaacuucaagcacgacgagaugugggacgacuucaucuucggcgugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugaaccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacagcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccgugacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacgccgaccugaccguggagggcgugugcaccggcugcaucaacugcuucgagaacauccacugcgagcugaccauccacagcaccguggaggccagcugccccguggugagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaagggcgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9350 - RNA, 4323 nt, Artificial Sequence
  derived and/or modified CDS sequence (opt4) from TAHV(90)__GQ386827.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaagguggccggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcugaccaacuuccugaucggcuacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacaucaaguacaugaagggccugaccgagaugaacaacuucaagcacgacgagaugugggacgacuucaucuucgaggugccccccaccaagagccccagcgugagaagacuggagagcagcuacgacuucaagaccgacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacaacaaguucuacuacagcgagcugcagaaggacuacgacaaggaccaggacaucggccacuucugccugagccccagaugcaacaccaucagacaccccaucaacagaaagcacaucagcaacugcaccuggcaggugaaccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccgugacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccguggugagcagcugcaccgccuuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9351 - RNA, 4323 nt, Artificial Sequence
  derived and/or modified CDS sequence (opt4) from TAHV(94)__GQ386828.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucagaaacgccaccggcaccuacgccaacaacguggccaucagaaaguggcuggugagcgacuggcacgacugcagacccaagaaggugagcggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacaucuacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaaggugaacauguacuacaucaugugcaugaucaacuacgccgugaccuggagcuucauccugugcgcccugcugaucgcccugcuguucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccgcccugcugacccacagaaagaccuacaacugccuggugcaguacaagagcaaguggcugaccaacuuccugaucguguacaucauccugaugcugaucaaggacagcgugcugaucgugcacgccgacggcaccgacuucgagaagugcagcggcgaggccgacaucaccuggaacugcaccggccccuuccugaaccugggcaacugcgagaagaagcagaagaaggagagcuacaacaacaucgccacccagcugaagggccuggacgccaucagcgugcuggacauccccaugaucagcaagauccccgaggacaucgccggcgcccugagauucaucgaggagcagagaagcuaccacgugcagcugaccgccgaguacgccaugcugaccagauacugcgacuacuacacccaguucaccgacaacagcggcuacagccagaccaccuggagaguguaccugagaagccacgacuucgaggugugcauccuguaccccaaccagcacuucugcagaugcgugaagcacggcgacaagugcagcagcagcaacugggacuucgccaacgagaugaagaacuacuacagcggcaagcagagcaaguucgacaaggaccugaaccuggcccugaugagccugcaccacgccuucagaggcaccagcagcuucuacaucgccaagcugcugaaggagaagaagaacgaggaccuggugaccuacgccgagaagaucaagggcaaguaccccggcaacgcccugcugaaggccaucaucgacuacgugaaguacaugaaggaccugaccgagaugaacaacuucaagcacgacgagaugugggacgacuucaucuucgaggugccccccaccaagagccccagcgugagaagacuggagagcagcuacgacuucaagaccaacgugaacagcaaccccagccacaucugcaagaacaucaagaccguggugugccugagccccaagagcggcgugagcuacgacagcaucaucgccugcggcgagcccagccagcccagcaucuacagaaagcccgacagccagguguuccagagcaacgccgaccagacccacuucugccugagcgacacccacugccuggagaacuacgagaccgugggcgaggagaucaucgacgccaucaagaagagcaagugcugggagaccgaguucaccgaguacauccaguucaagcagagcgacggcgugagaagcugcagaaugaaggacagcggcgagugcaccgugaccaccaacagauggcccaucauccugugcgacaacgacaaguucuacuacagcgagcugcagaaggacuacgacaaggaccaggacaucggccacuucugccugagccccagaugcaacaccaucagacaccccaucaacagaaagcacaucagcaacugcaccuggcaggugagccacaacaacaucgacaagaucgaggugcacgagcuggaggaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggacgagaucaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcgugaacugcuucgagaacauccacugcgagagcaccauccacagcaccguggaggccagcugccccgugaucagcagcugcaccguguuccacgacagaauccugaucacccccaacgagcacaaguacgccaucaaggugaucugcaacgagaagcccggccccacccugcccuucaagaucugcagcgccaagaccgacgccgccaugacccuggccgacgccaagcccauccuggagcuggcccccguggaccagaccaccuacaucaaggagaaggacgagagaugcaagaccuggaugugcagagugagagacgagggcuuccaggugaucuucgagcccuucaagaaccuguucggcagcuacaucggcaucuucuacaccuucaucaucagccugauggccaucuucaucgugaucuacaucgugcugcccaucugcuucaagcugagagacacccugagacagcacgaggacgccuacaagagagagaugaagaucagauga

SEQ ID NO: 9352 - RNA, 4323 nt, Artificial Sequence
  derived and/or modified CDS sequence (opt4) from TAHV(XJ0625)__EU622819.2__GP
augauguucgugcuguucuucaucgcccugagcaccgccagccccguguaccagagaugcuuccaggacggcgccaucgugaagcagaaccccagcaagcaggccgugaccgaggugugccugaaggacgacgugagcaugaucaagaccgaggccagauacuucaagaacgccaccggcaccuacgccaacaacguggccaucagaaaguggcuggugagcgacuggcacgacugcagacccaagaagguggccggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuaccugcugaugcccaucuucaucccccuggccuacguguacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcgugaucaccgccgugcugauccugaccuucgugacccccaucaacgccaugguggccggcgacacccaggagaccuucaagcuggaggaccugcccgacgacaugcugagcauggccaugaagauccagauguacuacaucaugugcaucgugaacuacaucgugaccuggagcuucaucgugugcgcccugaucaucgcccugaucuucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcuggugaacuuccugaucaucuacauccugcugaugcuggugaaggacagcgugcugaucgugcaggccgagggcaccgacuucgagaagugcagcggcgagaucaacaucaccuggaacugcaccggccccuuccugaaccugggcaacugcgagaagaagcagaagaaggagcccuacagcaacaucgccacccagcugaagggccuggacgccaucagcauccuggacauccccaugaucagcagaauccccgaggacaucgccggcgcccugagauucaucgaggagcagaacagcuaccacgugcagcugaccgccgaguacgccaugcugaccagauacugcgacuacuacacccaguucagcgacaacagcggcuacagccagaagaccuggagaguguaccugagaagccacgacuucgaggccugcauccuguaccccaaccagcacuucugcagaugcgugaagcacggcgacaagugcagcagcagcaacugggacuucgccagcgagaugaagaacuacuacaccggcaagcagcugaaguucaacaaggaccugaaccuggcccugaugagcuuccaccacgccuucagaggcaccagcagcuucuacguggccaagcugcugagagagaagaacaacgaggagcuggugaacuacaccgagaagaucaaggacaaguaccccggcaacgcccugcugaaggccaucaucgacuacaucaaguacaugaagaaccugagcgagaugaccaacuucaagcacgacgagaugugggacgacuucguguucaacagcccccccaccaagagccccagcgugagaagaagcgacagcgccuacgacuucaagaacaacaucaacagcaaccccagccacaucugccagaacaucaagaccgugaucugccugagccccaagagcggcgugagcuacgacagcaucaucgccugcggcgagcccagccagcccaccaucuacaagaagcccgagagcagaguguuccagagcaacgccgaccagacccacuucugccuggccgacacccacugccuggagaacuacgagaccgugggcgaggagauccuggacgccaucaagaagagcaagugcugggagaccgacuucaccgaguacauccaguucaagcagagcgacggcgugagaagcugcagaaugaaggacagcggcgagugcaccgugaccacccacagauggcccaucauccugugcgacaacaacaaguucuacuacagcgagcugcagaaggacuacgacaaggaccaggacaucggccacuucugccugagccccagaugcaacaccaucagacaccccaucaaccagaagcacaucagcaacugcaccuggcaggugagccacaacaacaucgagaagaucgaggugcacgagcuggagaaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggaggagcuggccguguacagaaaggagaccgaggagaccaccgacguggagcugugccugaccuucgccgacaagaccuacugcaccaaccugaacgccaucacccccaucaucaccgaccaguucgaggugcaguucaagaccguggagagcuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccgugaccagcagcugcaccguguuccacgacagaauccugaucacccccaacgagcacaaguacgccaucaaggugaucugcgccgagaagcccggccccagccugcaguucaagaucugcaacgccaagaccgacgccgccaugacccuggccgacgccaagcccauccuggagcuggcccccguggaccagaccaccuacaucaaggagaaggacgugagaugcaagaccuggaugugcagagugagagacgagggccugcaggugaucuucgagcccuucaagaaccuguucggcagcuacaucggcaucuucuacaccuuccugaucacccugaucgccguguucguggugaucuacaucgugcugcccaucugcuucaagcugagagacacccugagacagcacgaggacgccuacaagagagagaugaagaucagauga

SEQ ID NO: 9353 - RNA, 4323 nt, Artificial Sequence
  derived and/or modified CDS sequence (opt4) from TAHV(XJ0708)__HM243138.1__GP
augauccuggugcugguguucguggcccugagcgccgccagccccguguaccagagaugcuuccaggacggcgccaucgugaagcagagccccagcaagcaggccgugaccgaggugugccugaaggacgacgugagcaugaucaagaccgaggccagauacuucaagaacgccaccggcaccuacgccaacaacguggccaucagaaaguggcuggugagcgacuggcacgacugcagacccaagaagaucagcggcggccacaucaacgugaucgaggugggcgacgaccugacccugcacaccgaggccuacgugugcaacgccgacugcaucaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuacauccugaugcccaucuucaucccccuggccuacguguacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugaucgccggcgagacccaggagaccuucaagcuggaggaccugcccgacgacaugcugagcauggccaugaagcugaacauguacuaccugaugugcaucgugaacuacaucgugaccuggagcuucaucaucugcgcccugaucaucgcccugaucuucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcuggugaacuuccugaucguguacauccugcugaugcuggugaaggacagcauccugaucgugcaggccgagggcaccgacuucgacaagugcagcggcgaggccggcaucaucuggaacugcaccggccccuuccugaaccugggcaacugcgagaagaagcagaagaaggagagcuacaacaacaucgccacccagcugaagggccugaacgccaucagcgugcuggacauccccaugaucagcagaauccccgaggacaucgccggcgcccugagauucaucgaggaccagaacagcuaccacgugcagcugaccgccgaguacgccaugcugaccagauacugcgacuacuacacccaguucagcgacaacagcggcuacagccagaccaccuggagaguguaccugagaagccacaacuucgaggccugcauccuguacagcaaccagcacuucugcagaugcgugaagcacggcgacaagugcagcagcagcaacugggacuucgccaacgagaugaagaacuacuacagcggcaagcagagcaaguucaacaaggaccugaaccuggcccugaugagccugcaccacgccuucagaggcaccagcagcuucuacaucgccaagcugcugagagagaagaagaacgaggagcugaucaacuacguggaggagaucaagaagaaguaccccggcaacgcccugcugaaggccgugaucgacuacaucaaguacaugaagaaccugaccgagauggccagcuucaagcacgacgagaugugggacgaguucguguacgagagcccccccaccagaagccccagcgccagaagaagcgagagcgaguacgacuucaagaccaacgugaacagcaagcccacccacgugugcaagaacaucaagaccguggugugccugagccccaagagcggcgugagcuacgacagcaucaucgccugcggcgagcccggccagcccagcguguacagaaagcccgagcagcagguguuccagagcaacgccgaccagacccacuucugccugcuggacacccacugccuggagaacuacaccaccgugaacgacgagauccuggacgccaucaagaagagcagaugcugggagaccgaguucaccgaguacauccaguucaagcagggcgacggcgugagaagcugcagaaugaaggacagcggcgagugcgccguggccgccaacagauggcccaucauccugugcgacaacaacaaguucuacuacagcgagcugcagaaggacuacgacaaggaccaggacaucggccacuucugccugagccccagaugcaacaccaucagacaccccaucaaccagaagcacaucagcaacugcaccuggcaggugagccacaacaacaucgagaagaucgaggugcacgagcuggagaaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcagcguguacaccagacuguacaccaccggccccaccaucggcaucaacaccagacacgacgagcugugcaccggccccugccccgugaacgugccccacaacaccggcuggcugaccuucgccaaggagagaaccagcagcuggggcugcgaggaguucggcugccuggccaucagcgacggcugcguguucggcagcugccaggacaucaucaaggaggagcugaccguguacagaaaggagaccgaggagaccaccgacguggagcugugccugaccuucgccgacaagaccuacugcaccaaccugaacgccaucacccccaucaucaccgaccaguucgaggugcaguucaagaccguggaggccuacagccugcccagaaucaucgccgugagaaaccacgagauccuggugggccagaucaacgaccugggcguguacagcaagggcugcggcaacgugcagaaggugaacaagaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcaccgugaccgugaucgacuacaagaagauccugggcaccaucaagaugaaggccauccugggcgacgugaaguacaagaccuucgccgacaacguggaccugaccaucgagggcgugugcaccggcugcaucaacugcuucgagaacauccacugcgagcugaccauccacagcaccguggaggccagcugccccaucaucagcagcugcaccguguuccacgacagaauccugaucacccccaacgagcacaaguacgccaucaaggugaucugcaacgagaagcccggcagcagccugagcuucagagugugcaacaccaagaccgacgccgccaugacccugaccgacgccaagcccauccuggagcuggcccccguggaccagaccgccuacaucaaggagaaggacgagagaugcaagaccuggaugugcagagugagagacgagggccugcaggugaucuucgagcccuucaagaaccuguucggcagcuacaucggcaucuucuacaccuucauccugagccugaucgccaucuucaucaucaucuacaucgugcugcccaucugcuucaagcugagagacacccugagacagcacgaggacgccuacaagagagagaugaagaucagauga

SEQ ID NO: 9354 - RNA, 4323 nt, Artificial Sequence
  derived and/or modified CDS sequence (opt4) from TAHV(XJ0710)__HM243141.1__GP
augauguucgugcuguucuucaucgcccugagcgccgccagccccguguaccagagaugcuuccaggacggcgccaucgugaagcagaaccccagcaagcaggccgugaccgaggugugccugaaggacgacgugagcaugaucaagaccgaggccagauacuucaagaacgccaccggcaccuacgccaacaacguggccaucagaaaguggcuggugagcgacuggcacgacugcagacccaagaagguggccggcggccacaucaacgugaucgaggugggcgacgaccugacccugcacaccgaggccuacgugugcaacgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccagcagcaucugccagaacguggagaucaucauccugaccgugcugacccugcugaucuucauccugcugagcauccugagcaagaccuacaucugcuaccugcugaugcccaucuucaucccccuggccuacguguacggcgugaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaucaccgccgugcugauccugaccuucgugacccccaucaacgccaugguggccggcgacacccaggagaccuucaagcuggaggaccugcccgacgacaugcugagcauggccaugaagauccagauguacuacaucaugugcaucgugaacuacaucgugaccuggagcuucaucgugugcgcccugaucaucgcccugaucuucaagaaguaccagcacagauuccugaacuucuacgccauguacugccacgagugcgacauguaccacgacagaagcggccugaaguacaacggcgacuucaccaacaagugcagacagugcaccugcggccaguacgaggacgccgccggccugcugacccacagaaagaccuacaacugccuggugcaguacaagagcaaguggcuggugaacuuccugaucaucuacauccugcugaugcuggugaaggacagcgugcugaucgugcaggccgagggcaucgacuucgagaagugcagcggcgagaucaacaucaccuggaacugcaccggccccuuccugaaccugggcaacugcgagaagaagcagaagaaggagcccuacagcaacaucgccacccagcugaagggccuggacgccaucagcauccuggacauccccaugaucagcagaauccccgaggacaucgccggcgcccugagauucaucgaggagcagaacagcuaccacgugcagcugaccgccgaguacgccaugcugaccagauacugcgacuacuacacccaguucagcgacaacagcggcuacagccagaccaccuggagaguguaccugagaagccacgacuucgaggccugcauccuguaccccaaccagcacuucugcagaugcgugaagcacggcgacaagugcagcagcagcaacugggacuucgccagcaagaugaagaacuacuacaccggcaagcagcugaaguucaacaaggaccugaaccuggcccugaugagcuuccaccacgccuucagaggcaccagcagcuucuacguggccaagcugcugagagagaagaacaacgacgagcuggugaacuacaccgagaagaucaagaacaaguaccccggcaacgcccugcugaaggccaucaucgacuacaucaaguacaugaagagccugagcgagaugaccaacuucaagcacgacgagaugugggacgacuucguguucaacagcccccccaccaagagccccagcgugagaagaagcgacagcgccuacgacuucaagaacaacaucaacagcaaccccagccacaucugcaagaacaucaagaccguggugugccugagccccaagagcggcgugagcuacgacagcaucaucgccugcggcgagcccagccagcccaccaucuacaagaagcccgagagcagaguguuccagagcaacgccgaccagacccacuucugccuggccgacacccacugccuggagaacuacgagaccgugggcgaggagauccuggacgccaucaagaagagcaagugcugggagaccgacuucaccgaguacauccaguucaagcagagcgacggcgugagaagcugcagaaugaaggacagcggcgagugcaccgugaccaccaacagauggcccaucauccugugcgacaacaacaaguucuacuacagcgagcugcagaaggacuacgacaaggaccaggacaucggccacuucugccugagccccagaugcaacaccaucagacaccccaucaaccagaagcacaucagcaacugcaccuggcaggugagccacaacaacaucgagaagaucgaggugcacgagcuggagaaccuggagcaguacaagaaggccaucacccagaagcugcagaccagccugacccuguucaaguacagcaagaccaagaaccugccccacaucaagcccauguacaaguacaucaccaucgagggcaccgagaccgccgagggcaucgagagcgccuacaucgagagcgagauccccgcccuggccggcaccagcaucggcuucaagaucaccagcaagagcggcaagcaccugcuggacgugaucggcuacgugaagagcgccagcuacagcgccguguacaccaagcuguacaccaccggccccaccaucggcgugaacaccaagcacgacgagcugugcaccggccccugccccgugaacgugccccacggcaccggcuggcugaccuucgccaaggagagaaccagcagcuggggcugcgaggaguucggcugccuggccaucagcgacggcugcguguucggcagcugccaggacaucaucaaggaggagcuggccguguacagaaaggagaccgaggaggccaccgacguggagcugugccugaccuucgccgacaagaccuacugcaccaaccugaacgccaucacccccaucaucaccgaccaguucgaggugcaguucaagaccguggagagcuacagccugcccagaaucaucgccgugagaaaccacgagaucauggugggccagaucaacgacaucggcguguacagcaagggcugcggcaacgugcagaaggugaacaacaccaacuacggcaacggcgugcccaaguucgacuaccugugccaccuggccagcagaaaggaggugaucgugagaaagugcuucgacaacgacuaccaggccugcaaguuccugcagacccccgccagcuacagacuggaggaggagggcggcagcgugaccgugaucgacuacaagaagauccugggcaccaucaagaugaaggccauccugggcgacgugaaguacaagaccuucgccgacaacguggaccugaccguggagggcgugugcaccggcugcaucaacugcuucgagaacauccacugcgagcugaccauccacagcaccguggaggccagcugccccgugaccagcagcugcaccguguuccacgacagaauccugaucacccccaacgagcacaaguacgccaucaaggugaucugcgccgagaagcccggccccagccugcaguucaagaucugcaacgccaagaccgacgccgccaugacccuggccgacgccaagcccauccuggagcuggcccccguggaccagaccaccuacaucaaggagaaggacgagagaugcaagaccuggaugugcagagugagagacgagggccugcaggugaucuucgagcccuucaagaaccuguucggcagcuacaucggcaucuucuacaccuuccugaucacccugaucgccguguucaucgugaucuacaucgugcugcccaucugcuucaagcugagagacacccugagacagcacgaggacgccuacaagagagagaugaagaucagauga

SEQ ID NO: 9355 - RNA, 4326 nt, Artificial Sequence
  derived and/or modified CDS sequence (opt4) from TVTV__AF123491.1__GP
augaucguguucgcccugcugaccaucguggccgccagccccguguacaagagaugcuuccaggacggcgccaucgugagacaggaguacagcaagaacgccgugaccgaggugugccugaaggacgacgugagcaugaucaagaccgaggccgaguacuucaagaacagcaccggcguguucagcaagaacaucgccuacagaaaguggcuggugagcgacuggaacgagugcagaccccagaagagcgccaacggccacaucaacgugaucgaggugcagcccgaccugagccugcagaccaacagcuacgugugcgccgccaccugcgugaucagcaucgacaaggagaccgcccaggugagacugcagaccgacaccaccaaccacuucgagaucagcggcaccaccgugaagagcggcugguucaagagcaccaccuaccugacccuggaccagaccugcgagcaccugaagaucagcugcggcagcaagagcgugcagcugcacgccugcuucaaccagcacaugagcugcgugagauuccugcacagaaccauccugcccggcaagcacagaaagagcaucugccagaacaucgagaucaucauccugaccagccugagccuguucaucuuccuguuccugaccaucaucagcaagaccuacaucugcuacgugcugauccccaucuucauccccaucgccuacguguacggcuucaucuacaacaagagcugcaagaagugcaagcugugcggccugguguaccaccccuucaccgagugcggcagccacugcgugugcggcgccaaguacgacaccagcgacagaaugaagaugcacagaagcagcggccugugccccggcuacaagagccugagagccgccagaagcaugugcaagagcaagggccccgcccccauccugagccugcugagcgccgugcugauccugaccuucgugacccccaucaccgccaucagccugaaggacgaggagaaggagaccuacaagcugcccgagcugcccgacgacaaggugaaccuggagaccaagaucgaccuguacuuccagaugugccugaucaacuacgccaccaccugggcccugaucuucugcgugcugaucaccgccugccuguucaagaagcugcagcacaaguuccuggacuacuacgccguguacugccacgagugcgacauguaccacgagaagaccagccugaaguacaacggcgacuucagcaacaagugcagacagugcaccugcgagcaguacgaggacgccaccggccugcugacccacagaaagagcuacaacagacuggugcaguacaaggccaaguggacccugaacuuccugaucaccuacgccauccuggugaucaucaaggacagcgugaugaucgugggcgccagcaacaccgacgugaaggacugccuggaccaggaggagaucaccuggaacugcaccggccccuuccugaacaugggcagaugcaccagaccccagaagaaggagaacuacggcaacaucgccacccagcugaagggccuggacgugcugagcgcccuggacaugcccgccgugggcaagauccccgaggacaucgccggcgcccugagcuacaucgagagcaagaagaccuaccacgagcagcugacccuggaguucgccaugcugaccagauacugcgacuucuacaagcaguacgccgacaacagcggcuacagccagaccaccuggagagccuacaucagaagccacgacuucggcgugugcaucauguaccccaaccagcacuucugcagaugcgugaagaugggcgagaagugcaccagcagcaacugggacuucgccaaccagauggccaacuacuacaacggcaagcagaacagauucaacaaggaccugaaccuggcccuguacaccaugcaccacgccuucagaggcagcaccagcuaccugaucagcaaggugcugcacgagaagaaguacgaccagcugaccaaccugcugacccagcugaagaccaaguaccccggcaacgcccugcugaaggcccugaucggcuaccagaucuaccugaagagccugagcgagaugagcagcuucacccccgacgagcugugggacgaccugcaguacgugcccgcccccaccuucaagcccaaccugggcagaagcggcgacaacgaguacaaguucgacaagagcagaaucguggacccccagaccaccugcaccagccugaagggcgugaacugccugagccccagaagcagagccagcgugagcgacaucaucgccugcggccaggccacccagcccgcccuguucuacgugcccaacgacaagauccaccagagcaacaccgaccagaaccaguacugcaucggcgacagccacugccugaccaaguucacccccaucaccgaggagcugcuggccgccgugaagaagagcaagugccaggccuucgaccuggacaacaucgugaagaccagcaccagcaccggcgugagaagcugccuggugaagaaguucggcaacugcaacaccaccaaccagguguggcccaucaccaucugcagcgacgaccaguacuacuacaccgacaccaagcagagcuacgacagcuaccaggacaucggccacuucugccugagccccagaugcagcaccaucagauaccccgugaaccccaagcaccugagcgccugcaccuggaccgaggaguacacccccguggacaagaucagcgugaccaacaucgaggagaucgagcaguacaagaaggcccugcugcagaagcugcagaccggccugaacaucuucaaguacagaaagaccagcaaccugccccacaucaagagcauguacaaguacaucaccgugcagggcaccggcaccgccgagggcguggagaacgccuacaucgagagcgagaugcccgcccuggccggcagcagcagcggcuucaaggugcugagcaaggagggcaaccaccuguucgacgugguggccuacaucaagagcgccagcuacagcagcguguacaacaagcuguacagcaccggccccacccugggcaucaacgugaagcacgacgagaagugcaccggccccugccccgccaacaucccccacaagaccggcuggcugaccuucgccagagagagaaccagcaccuggggcagagaggaguacggcugccuggccaucagcgacggcugcguguucggcagcugccaggacaucaucaagcccgagaugaccguguacagaaagcagaccgacgagaucgugaccguggagcugugccugaccuucguggacaagaccuacugcaccgagcugaacgccgugacccccaucaucagcgaccuguucgaggugcaguucaagaccguggagagcuacagccugcccaagaucguggccaucaagaaccaccagaucuucgugggccagaucaacgugaucggcaccaacagcaagggcugcggcaacgugcagguguucaacggcaccaacuacggcagcggcacccccagauucgacuaccugugccaccuggccagcagaagagaggugaucaugagaaagugcuucgacaacgacuaccaggccugcaaguuccugcagcagcccagcagcuucagacuggaggaggagggcgagaccgugaccaucaucgacuacaagaagauccugggcaccaucaagaugaaggccaucuucggcgacgugaaguacagaaccuucagcgagaagguggacaucaacgccgagggcgugugcgccggcugcaucaacugcuucgagagaaucaacugcgaguucaccauccacagcaccguggagaccagcugcccccugguggccgacugccagcuguuccacgacagacugcugaucacccccaacgagcacaaguacgccaucaaggccaucugcaaggacaagcccagcaacacccugagauucagcaucugcaacaccaagguggaggccaccgugaccaucaucgacgccaagcccauccuggagcuggcccccguggaccagaccgccuacaucaaggagaaggacgagagaugcaagaccuggcugugcagagugaaggacgagggcguggccgugcugcuggagcccuucaagaaccuguucggcagcuacaucggcaucuucuacggcaucauccugguggugcuggccauccuggugugcaucuacaucgugcugcccgugugcuucaagaucaaggacacccugaagaagcacgaggacgccuacaagagagagaugaagaucagauga

SEQ ID NO: 9356 - RNA, 4335 nt, Artificial Sequence
  derived and/or modified CDS sequence (opt4) from TVTV(AR42)__KX891322.1__GP
augagaaacaugaucguguucgcccugcugaccaucguggccgccagccccguguacaagagaugcuuccaggacggcgccaucgugagacaggaguacagcaagaacgccgugaccgaggugugccugaaggacgacgugagcaugaucaagaccgaggccgaguacuucaagaacagcaccggcguguucagcaagaacaucgccuacagaaaguggcuggugagcgacuggaacgagugcagaccccagaagagcgccaacggccacaucaacgugaucgaggugcagcccgaccugagccugcagaccaacagcuacgugugcgccgccaccugcgugaucagcaucgacaaggagaccgcccaggugagacugcagaccgacaccaccaaccacuucgagaucagcggcaccaccgugaagagcggcugguucaagagcaccaccuaccugacccuggaccagaccugcgagcaccugaagaucagcugcggcagcaagagcgugcagcugcacgccugcuucaaccagcacaugagcugcgugagauuccugcacagaaccauccugcccggcaacaucgccaacagcaucugccagaacaucgagaucaucauccugaccagccugagccuguucaucuuccuguuccugaccaucaucagcaagaccuacaucugcuacgugcugauccccaucuucauccccaucgccuacguguacggcuucaucuacaacaagagcugcaagaagugcaagcugugcggccugguguaccaccccuucaccgagugcggcagccacugcgugugcggcgccaaguacgacaccagcgacagaaugaagaugcacagaagcagcggccugugccccggcuacaagagccugagagccgccagaagcaugugcaagagcaagggccccgccagcauccugagccugcugagcgccgugcugauccugaccuucgugacccccaucaccgccaucagccugaaggacgaggagaaggagaccuacaagcugagcgagcugcccgacgacauggugaaccuggagaacaagaucgaccuguacuuccagaugugccugaucaacuacgccaccaccugggcccugaucuucugcgcccugaucaccgccugccuguucaagaagcugcagcacaaguuccuggacuacuacgccguguacugccacgagugcgacauguaccacgagagaagaggccugaaguacaacggcgacuucagcaacaagugcagacagugcaccugcggccaguacgaggacgccaccggccugcugacccacagaaagagcuacaacugccuggugcaguacaaggccaaguggaugcugaacuuccugaucaccuacgccauccuggugaucaucaaggacagcgugaugaucgugggcgccagcgacaccgacgugaaggacugccuggaccaggaggagaucaccuggaacugcaccggccccuuccugaacaugggcagcugcaccagaccccagaagaaggagaacuacggcaacaucgccacccagcugaagggccuggacgugcugagcgcccuggacaugcccgccgugggcaagauccccgaggacaucgccggcgcccugagcuacaucgagagcaagaagaccuaccacgagcagcugacccuggaguucgccaugcugaccagauacugcgacuucuacaagcaguacgccgacaacagcggcuacagccagaccaccuggagagccuacaucagaagccacgacuucggcgugugcaucauguaccccaaccagcacuucugcagaugcgugaagaugggcgagaagugcaccagcagcaacugggacuucgccaaccagauggccaacuacuacaacggcaagcagaacagauucaacaaggaccugaaccuggcccuguacaccaugcaccacgccuucagaggcagcaccagcuaccugaucagcaaggugcugcacgagaagaaguacgaccagcugaccaaccugcugacccagcugaagaccaaguaccccggcaacgcccugcugaaggcccugaucgacuaccagaucuaccugaagagccugagcgagaugagcagcuucacccccgacgagcugugggacgaccugcaguacgugcccgcccccaccuucaagcccaaccugggcagaagcgaggacaacgaguacaaguucgacaagagcagaaucguggacccccagaccaccugcaccagccugaagggcgugaacugccugagccccagaagcagagccagcgugagcgacaucaucgccugcggccaggccacccagcccgcccuguucuacgugcccaacgacaagauccaccagagcaacaccgaccagaaccaguacugcaucggcgacagccacugccugaccaaguucacccccaucaccgaggagcugcuggccgccgugaagaagagcaagugccaggccuucgaccuggacgacaucgugaagaccagccccagcaccggcgugagaagcugccuggugaagaaguucggcaacugcaacaccaccaaccagguguggcccaucaccaucugcagcgacgaccaguacuacuacaccgacaccaagcagagcuacgacagcaaccaggacaucggccacuucugccugagccccagaugcagcaccaucagauaccccgugaaccccaagcaccugagcgccugcaccuggaccgaggaguacacccccguggacaagaucagcgugaccaacaucgaggagaucgagcaguacaagaaggcccugcugcagaagcugcagaccggccugaacaucuucaaguacaagaagaccagcaaccugccccacaucaagcccauguacaaguacaucaccgugcagggcaccgagaccgccgagggcguggagaacgccuacaucgagagcgagaugcccgcccuggccggcagcagcagcggcuucaaggugcugagcaaggagggcaaccaccuguucgacgugguggccuacaucaagagcgccagcuacagcagcguguacaacaagcuguacagcaccggccccacccugggcaucaacgugaagcacgacgagaagugcaccggccccugccccgccaacaucccccacaagaccggcuggcugaccuucgccagagagagaaccagcaccuggggcugcgaggaguacggcugccuggccaucagcgacggcugcguguucggcagcugccaggacaucaucaagcccgagaugaccguguacagaaagcagaccgacgagaucgugaccguggagcugugccugaccuucguggacaagaccuacugcaccgagcugaacgccgugacccccaucaucagcgaccuguucgaggugcaguucaagaccguggagagcuacagccugcccaagaucguggccaucaagaaccaccagaucuucgugggccagaucaacgacaucggcaccuacagcaagggcugcggcaacgugcagguguucaacggcaccaacuacggcagcggcacccccagauucgacuaccugugccaccuggccagcagaaaggaggugaucaugagaaagugcuucgacaacgacuaccaggccugcaaguuccugcagcagcccagcagcuucagacuggaggaggagggcgagaccgugaccaucaucgacuacaagaagauccugggcaccaucaagaugaaggccaucuucggcgacgugaaguacaagaccuucagcgagaagguggacaucaacgccgagggcgugugcgccggcugcaucaacugcuucgagagcaucaacugcgaguucaccauccacagcaccguggagaccagcugcccccugguggccgacugccagcuguuccacgacagacugcugaucacccccaacgagcacaaguacgccaucaaggccaucugcaaggacaagcccagcaacacccugagauucagcaucugcaacaccaagguggaggccaccgugaccaucaucgacgccaagcccauccuggagcuggcccccguggaccagaccgccuacaucaaggagaaggacgagagaugcaagaccuggcugugcagagugaaggacgagggcguggccgugcugcuggagcccuucaagaaccuguucggcagcuacaucggcaucuucuacggcaucauccugguggugcuggccauccuggugugcaucuacaucgugcugcccgugugcuucaagaucagagacacccugaagaagcacgaggacgccuacaagagagagaugaagaucagauga

SEQ ID NO: 9357 - RNA, 4335 nt, Artificial Sequence
  derived and/or modified CDS sequence (opt4) from TVTV(Eklund)__KR149248.1__GP
augagaaacaugaucguguucgcccugcugaccaucguggccgccagccccguguacaagagaugcuuccaggacggcgccaucgugagacaggaguacagcaagaacgccgugaccgaggugugccugaaggacgacgugagcaugaucaagaccgaggccgaguacuucaagaacagcaccggcguguucagcaagaacaucgccuacagaaaguggcuggugagcgacuggaacgagugcagaccccagaagagcgccaacggccacaucaacgugaucgaggugcagcccgaccugagccugcagaccaacagcuacgugugcgccgccaccugcgugaucagcaucgacaaggagaccgcccaggugagacugcagaccgacaccaccaaccacuucgagaucagcggcaccaccgugaagagcggcugguucaagagcaccaccuaccugacccuggaccagaccugcgagcaccugaagaucagcugcggcagcaagagcgugcagcugcacgccugcuucaaccagcacaugagcugcgugagauuccugcacagaaccauccugcccggcaacaucgccaacagcaucugccagaacaucgagaucaucauccugaccagccugagccuguucaucuuccuguuccugaccaucaucagcaagaccuacaucugcuacgugcugauccccaucuucauccccaucgccuacguguacggcuucaucuacaacaagagcugcaagaagugcaagcugugcggccugguguaccaccccuucaccgagugcggcagccacugcgugugcggcgccaaguacgacaccagcgacagaaugaagaugcacagaagcagcggccugugccccggcuacaagagccugagagccgccagaagcaugugcaagagcaagggccccgccagcauccugagccugcugagcgccgugcugauccugaccuucgugacccccaucaccgccaucagccugaaggacgaggagaaggagaccuacaagcugagcgagcugcccgacgacauggugaaccuggagaccaagaucgaccuguacuuccagaugugccugaucaacuacgccaccaccugggcccugaucuucugcgcccugaucaccgccugccuguucaagaagcugcagcacaaguuccuggacuacuacgccguguacugccacgagugcgacauguaccacgagagaagaggccugaaguacaacggcgacuucagcaacaagugcagacagugcaccugcggccaguacgaggacgccaccggccugcugacccacagaaagagcuacaacugccuggugcaguacaaggccaaguggaugcugaacuuccugaucaccuacgccauccuggugaucaucaaggacagcgugaugaucgugggcgccagcaacaccgacgugaaggacugccuggaccaggaggagaucaccuggaacugcaccggccccuuccugaacaugggcagaugcaccagaccccagaagaaggagaacuacggcaacaucgccacccagcugaagggccuggacgugcugagcgcccuggacaugcccgccgugggcaagauccccgaggacaucgccggcgcccugagcuacaucgagagcaagaagaccuaccacgagcagcugacccuggaguucgccaugcugaccagauacugcgacuucuacaagcaguacgccgacaacagcggcuacagccagaccaccuggagagccuacaucagaagccacgacuucggcgugugcaucauguaccccaaccagcacuucugcagaugcgugaagaugggcgagaagugcaccagcagcaacugggacuucgccaaccagauggccaacuacuacaacggcaagcagaacagauucaacaaggaccugaaccuggcccuguacaccaugcaccacgccuucagaggcagcaccagcuaccugaucagcaaggugcugcacgagaagaaguacgaccagcugaccaaccugcugacccagcugaagaccaaguaccccggcaacgcccugcugaaggcccugaucgacuaccagaucuaccugaagagccugagcgagaugagcagcuucacccccgacgagcugugggacgaccugcaguacgugcccgcccccaccuucaagcccaaccugggcagaagcgaggacaacgaguacaaguucgacaagagcagaaucguggacccccagaccaccugcaccagccugaagggcgugaacugccugagccccagaagcagagccagcgugagcgacaucaucgccugcggccaggccacccagcccgcccuguucuacgugcccaacgacaagauccaccagagcaacaccgaccagaaccaguacugcaucggcgacagccacugccugaccaaguucacccccaucaccgaggagcugcuggccgccgugaagaagagcaagugccaggccuucgaccuggacaacaucgugaagaccagccccagcaccggcgugagaagcugccuggugaagaaguucggcaacugcaacaccaccaaccagguguggcccaucaccaucugcagcgacgaccaguacuacuacaccgacaccaagcagagcuacgacagcuaccaggacaucggccacuucugccugagccccagaugcagcaccaucagauaccccgugaaccccaagcaccugagcgccugcaccuggaccgaggaguacacccccguggacaagaucagcgugaccaacaucgaggagaucgagcaguacaagaaggcccugcugcagaagcugcagaccggccugaacaucuucaaguacagaaagaccagcaaccugccccacaucaagcccauguacaaguacaucaccgugcagggcaccgagaccgccgagggcguggagaacgccuacaucgagagcgagaugcccgcccuggccggcagcagcagcggcuucaaggugcugagcaaggagggcaaccaccuguucgacgugguggccuacaucaagagcgccagcuacagcagcguguacaacaagcuguacagcaccggccccacccugggcaucaacgugaagcacgacgagaagugcaccggccccugccccgccaacaucccccacaagaccggcuggcugaccuucgccagagagagaaccagcaccuggggcugcgaggaguacggcugccuggccaucagcgacggcugcguguucggcagcugccaggacaucaucaagcccgagaugaccguguacagaaagcagaccgacgagaucgugaccguggagcugugccugaccuucguggacaagaccuacugcaccgagcugaacgccgugacccccaucaucagcgaccuguucgaggugcaguucaagaccguggagagcuacagccugcccaagaucguggccaucaagaaccaccagaucuucgugggccagaucaacgacaucggcaccuacagcaagggcugcggcaacgugcagguguucaacggcaccaacuacggcagcggcacccccagauucgacuaccugugccaccuggccagcagaaaggaggugaucaugagaaagugcuucgacaacgacuaccaggccugcaaguuccugcagcagcccagcagcuucagacuggaggaggagggcgagaccgugaccaucaucgacuacaagaagauccugggcaccaucaagaugaaggccaucuucggcgacgugaaguacaagaccuucagcgagaagguggacaucaacgccgagggcgugugcgccggcugcaucaacugcuucgagagcaucaacugcgaguucaccauccacagcaccguggagaccagcugcccccugguggccgacugccagcuguuccacgacagacugcugaucacccccaacgagcacaaguacgccaucaaggccaucugcaaggacaagcccagcaacacccugagauucagcaucugcaacaccaagguggaggccaccgugaccaucaucgacgccaagcccauccuggagcuggcccccguggaccagaccgccuacaucaaggagaaggacgagagaugcaagaccuggcugugcagagugaaggacgagggcguggccgugcugcuggagcccuucaagaaccuguucggcagcuacaucggcaucuucuacggcaucauccugguggugcuggccauccuggugugcaucuacaucgugcugcccgugugcuucaagaucaaggacacccugaagaagcacgaggacgccuacaagagagagaugaagaucagauga

SEQ ID NO: 9358 - RNA, 4335 nt, Artificial Sequence
  derived and/or modified CDS sequence (opt4) from JCV(3324-04)__HM007357.1__GP
auggaggugcugaaccugaucuggcugcugacccugugccuggccagccccguguuccagagaugcuuccaggacggcgccaucgugaagcagaaccccagcaaggaggccgugaccgaggugugccugaaggacgacgugagcaugaucaagaccgaggccaaguacgugaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggugaucuucaucuuccugaccaucgugagcaagaccuacaucugcuaccugcugaugcccaucuucauccccaucgccuucaucuacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcgugcugagcaucaugaccgccgugcugauccugaccuucgugacccccaucagcgccauggugaucggcgagagcagcgagaucuacacccuggaggaccugcccgacgacauggugcagauggccgagagaaucaacaucuacuaccagaucaucaucaucaacuacggcaucaccugggccuuccugcugcugggccugcugcuggccuacuucuucagaaaguaccagcacagauuccuggacuucuacgccauguacugcgaggagugcgacauguaccacgagaaggccggccugacccacuggggcgacuucaccaacaagugcagacagugcaccugcggccaguacgaggacaucaccggccugauggugcacaagaagagcuacaacugccuggugaaguacaaggccaaguggaucagagacauccugaucaccuaccuggugaucauccuggugaaggacagccugcuguucgugggcgccaccggcaccgacuucgccaccugcaucgacgagaagaccgugaccuggaacugcaccggccccuuccugaaccugggcagaugcgacaagagccagaagaagaccaacuacgccgacaucgccaaccagcugaagggccugggcgugaucagcgugcuggacauccccaugaucaagaagaugcccgacgagaucagcggcagccugaaguacaucgacaaccuggagaccuaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaaguacggcgacaagugcaacagcgccaagugggacuucgccaacgagaugaagaccuucuacaccggccagaaggccaaguucaacaaggaccugaaccuggcccugcuggugcugcacaaggccuucagaggcaccggcaccgccuacaucgccgaggccauggccagaaaggacaacggcagcauggcccacuucgcccuggaggugagaaagaaguuccccaccaacgcccugcuggccgcccugaucgacuacaucguguaccugcagagccuggccgagaucagcaccuucgagcuggacgaggacugggaggacuucaaguacaagcccgagcccaccgagagcaccauccaggccagaagccacagagacgaccaguacaacuucaagaacgccgccagcggcagcaacgugaaggugugcaagaacauccagaaggugcugugcaucagccccagaagcagagccaaguucgagaacaucaucgccugcggcgagcacgccaaccccagcguguacaugaugcccaacgugagcaucuaccagagcagcagcgagagaagccacuacugcaucgccgacagccacugccuggaggaguacgaggugguggagaccgagcugcugaacgcccugaagaagagcaagugcugggugaaggagauggacgacgugauccugcacaagcagagcgacggccugagaagcugcagaaugaaggacaccggcaacugcaacgugcaggagaacgacuggaacaucgugcugugcgagaacggcaacuacuacuacagcgagauccacaaggacuacgacaaggaccaggacgugggccacuucugccugagccccagaugcaacaccaucagauaccccaucagcaagagacacaucagaagcugcaacuggcagaucagccacagcaccaucgacaagaucgccgugcaggagcuggccgacaucgagcaguacaagaaggccaucagccagaagcugcagaccagccugagcaucuucaaguacaucaagaccaagaaccugccccacaucaagcccgccuacaaguacaucaccguggagggcguggagaccguggagggcaucgagaacgccuucaucgagagcgagauccccgcccuggccggcaccgccaucggcuucaagaucaacagcagagagggcaacuaccugauggacgugaucggcuacgugaagagcgccagcuacagcgccaccuacaccaagcuguacaccaccggccccaccaucggcaucaacaccagacacgacgagaagugcaccggccccugccccgccgugaucgaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggaggccuacacccugcccagaaucaucgccgugaagaaccacgagaucaaggugggccagaucaacgaccugggcguguacagcaagggcugcggcaacgugcagaaggugaacggcaccaacuacggcaacggcgcccccagauucgacuaccugugccaccuggccagcagaaaggaggugauccugagaaagugcuucgacaacgacuaccaggccugcaaguuccugcagagccccagcagcuacagacuggaggagcaccagggcaccgugaccgugaucgacuacaagaagauccugggcaccaucaagaugaaggccauccugggcgacgugaaguacaagaacuuccagagcaacaucgagaucaacgccgagggcaccugcgccggcugcaucaacugcuucgagaacauccacugcgaguucaccauccacaccaccguggagaccagcugccccaucgugaccgacugcgugagcuuccacgacagaauccugaucacccccgacgagcacaaguacgcccugaagguggugugccaggacaagcccaaggugagccugaaguucaagaucugcaacaccaacaucgacgccagcaugaccaucguggacagcaagcccauccuggagcuggcccccguggaccagaccgccuacaucagagagaaggacgagagaugcaagaccuggaugugcagagugagagacgagggcuuccaggugauccuggagcccuucaagaaccuguucggcagcuacaucggcaucuucuacaccggcauccugagcaucaucugccugcugaucgugaucuacaucauccugcccaucugcuucaagcugagagacacccugagacagcacgaggacgccuacaagaaggagaugaagaucagauga

SEQ ID NO: 9359 - RNA, 4335 nt, Artificial Sequence
  derived and/or modified CDS sequence (opt4) from JCV(61V2235)__U88058.1__GP
auggaggugcugaaccugaucuggcugcuggcccugugcagcgccagccccguguuccagagaugcuuccaggacggcgccaucgugaagcagaaccccagcaaggaggccgugaccgaggugugccugaaggacgacgugagcaugaucaagaccgaggccaaguacgugaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggugaucuucaucuuccugagcaucgugagcaagaccuacgugugcuaccugcugaugcccaucuucacccccaucgccuucaucuacggcuggguguacaacaagagcugcaagaagugcaagcugugcggccugguguaccaccccuucaccgagugcggcacccacugcgugugcggcgccagauacgagaacagcgacagaaugaagcugcacagagccagcggccugugccccggcuacaagagccugagagccgccagagugaugugcaagagcaagggccccgccagcauccugagcaucaugaccgccauccugauccugaccuucgugacccccaucagcgccauggugaucggcgagagcagcgagcuguacacccuggacgaccugcccaacgacauggugcagauggccgagagagugaacaucuacuaccagaucaccaucaucaacuacggcgugaccugggccuucuucugccugggccugauccuggccuacuucuucaagaaguaccagcacaaguuccuggacuucuacgccauguacugcgaggagugcgacauguaccacgagaagagcggccugacccacuggggcgacuucaccaacaagugcagacagugcaccugcggccaguucgaggacguggccggccugaugauccacaagaagagcuacaacugccuggugaaguacaaggccaaguggaucagagacauccugaucaucuaccuggccaugauccugaucaaggacagccugcuguucgugggcgccagcggcaccgacuucgccgccugcaucgacgagaagguggugaccuggaacugcaccggccccuuccugaaccugggcagaugcgacaagagccagaagaaggccagcuacgccggcaucgccgaccagcugaagggccugggcgugaucagcgugcuggacauccccaugaucaagaacaugcccgacgagaucagcggcagccugaaguacaucgacagccuggagaccuaccacgagcagcugaccgccgaguacgccuuccugaccagauacugcgacuacuacacccaguacaccgacaagagcggcuacagccagaccguguggagaaccuaccugagaagccacgacuucggcgccugcgugguguaccccaaccagcacuucugcagaugcgugaaguacggcgacaagugcaacagcgccaagugggacuucgccaacgagaugaagaccuucuacaccggccagaaggugaaguucaacaaggaccugaaccuggcccugcuggugcugcacaaggccuucagaggcaccggcaccgccuacguggccgaggccauggccagagaggacaacggcagcauggcccacuucgcccuggagaucagaaagaaguuccccaccaacgcccugcuggccgcccugaucgacuacaucguguaccugcagagccugggcgagaucgccaccuucgagcuggacgaggacugggaggacuucaaguacaagcccgagcccaccgagagcaccccccaggugagaagccacagaaacgaccaguacaacuucaagaacgccgagagcaacagcgacaccaaggugugcaagaacgugcagaaggugcugugcaucagccccagaagcaaggccaaguucgagaacaucaucgccugcggcgagcacgccaaccccagcguguacaugaugcccaacgugagcaucuaccagagcaacagcgagagaagccacuacugcaucgccggcagccacugccuggagaaguacgaggugguggagaccgagcugcugaacgcccugaagaagagcaagugcugggccaaggagauggacgacaucauccugcacaagcagagcgacggccugagaagcugcagaaucaaggacaccggcaacugcaacgugcaggagaacgacuggaccaucgugcugugcgagaacggcaacuacuacuacagcgaggugcacaaggacuacgacaaggaccaggacgugggccacuucugccugagccccagaugcaccaccaucagauaccccaucagcaagagacacaucaagaagugcgaguggcagaucagccacagcaccaucgacaagaucagcgugcaggagcuggccgacaucgagcaguacaagaaggccaucagccagaagcugcagaccagccugagcaucuucaaguacgugagaaccaagaaccugccccacaucaagcccgccuacaaguacaucaccguggagggcguggagaccaucgagggcaucgagaacgccuucaucgagagcgagauccccgcccuggccggcaccgccaucggcuucaagaucaacagcagagagggcaacuaccugauggacgugaucggcuacgugaagagcgccagcuacagcgccguguacaccaagcuguacaccaccggccccaccaucggcaucaacaccaagcacgacgagaagugcaccggccccugccccgccaucaucgaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagagugaucgccaucaagaaccacgagaucaaggugggccagaucaacgaccugggcguguacagcaagggcugcggcaacgugcagaaggugaacggcaccaacuacggcaacggcagccccagauucgacuaccugugccaccuggccagcagaaaggaggugauccugagaaagugcuucgacaacgacuaccaggccugcaaguuccugcagagccccagcagcuacagacuggaggagcaccagggcaccgugaccgugaucgacuacaagaagauccugggcaccaucaagaugaaggccauccugggcgacgugaaguacaagaacuaccagaacaacaucgagaucagcgccgagggcaccugcgccggcugcaucgacugcuucgagaacauccacugcgaguucaccauccacaccaccguggaggccagcugccccaucaccaccgagugcgugagcuuccacgacagaauccugaucacccccgacgagcacaaguacgcccugaagaucgugugccacgacaagcccaaggugagccugaaguucaagaucugcaacacccacguggacgccgccaugaccaucguggacagcaagcccauccuggagcuggcccccguggaccagaccaccuacaucagagagaaggacgagagaugcaagaccuggaugugcagagugagagacgagggcuuccaggugauccuggagcccuucaagaaccuguucggcagcuacaucggcaucuucuacaccggcauccugagcaucaucugccugcugaucgugguguacaucauccugcccaucugcuucaagcugagagacacccugagacagcacgaggacgccuacaagaaggagaugaagaucagauga

SEQ ID NO: 9360 - RNA, 4335 nt, Artificial Sequence
  derived and/or modified CDS sequence (opt4) from JCV(61V2235)__HM007351.1__GP
auggaggugcugaaccugaucuggcugcuggcccugugcagcgccagccccguguuccagagaugcuuccaggacggcgccaucgugaagcagaaccccagcaaggaggccgugaccgaggugugccugaaggacgacgugagcaugaucaagaccgaggccaaguacgugaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggugaucuucaucuuccugagcaucgugagcaagaccuacgugugcuaccugcugaugcccaucuucauccccaucgccuucaucuacggcuggguguacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaugaccgccauccugauccugaccuucgugacccccaucagcgccauggugaucggcgagagcagcgagguguacacccuggacgaccugcccaacgacauggugcagauggccgagagagugaacaucuacuaccagaucaucaucaucaacuacggcgugaccugggccuuccugcugcugggccugauccuggccuacuucuucaagaaguaccagcacaaguuccuggacuucuacgccauguacugcgaggagugcgacauguaccacgagaagagcggccugacccacuggggcgacuucaccaacaagugcagacagugcaccugcggccaguucgaggacguggccggccugaugauccacaagaagagcuacaacugccuggugaaguacaaggccaaguggaucagagacauccugaucaucuaccuggccaugauccugaucaaggacagccugcuguucgugggcgccagcggcaccgacuucgccgccugcaucgacgagaagguggugaccuggaacugcaccggccccuuccugaaccugggcagaugcgacaagagccagaagaaggccagcuacgccggcaucgccgaccagcugaagggccugggcgugaucagcgugcuggacauccccaugaucaagaacaugcccgacgagaucagcggcagccugaaguacaucgacagccuggagaccuaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaaguacggcgacaagugcaacagcgccaagugggacuucgccaacgagaugaagaccuucuacaccggccagaaggugaaguucaacaaggaccugaaccuggcccugcuggugcugcacaaggccuucagaggcaccggcaccgccuacguggccgaggccauggccagaaaggacaacggcagcauggcccacuucgcccuggagaucagaaagaaguuccccaccaacgcccugcuggccgcccugaucgacuacaucguguaccugcagagccugggcgagaucgccaccuucgagcuggacgaggacugggaggacuucaaguacaagcccgagcccaccgagagcaccccccaggugagaagccacagaaacgaccaguacaacuucaagaacgccgagagcaacagcgacaccaaggugugcaagaacgugcagaaggugcugugcaucagccccagaagcaaggccaaguucgagaacaucaucgccugcggcgagcacgccaaccccagcguguacaugaugcccaacgugagcaucuaccagagcaacagcgagagaagccacuacugcaucgccgacagccacugccuggagaaguacgaggugguggagaccgagcugcugaacgcccugaagaagagcaagugcugggccaaggagauggacgacaucauccugcacaagcagagcgacggccugagaagcugcagaaucaaggacaccggcaacugcaacgugcaggagaacgacuggaccaucgugcugugcgagaacggcaacuacuacuacagcgaggugcacaaggacuacgacaaggaccaggacgugggccacuucugccugagccccagaugcaccaccaucagauaccccaucagcaagagacacaucaagaagugcgaguggcagaucagccacagcaccaucgacaagaucagcgugcaggagcuggccgacaucgagcaguacaagaaggccaucagccagaagcugcagaccagccugagcaucuucaaguacgugagaaccaagaaccugccccacaucaagcccgccuacaaguacaucaccguggagggcguggagaccaucgagggcaucgagaacgccuucaucgagagcgagauccccgcccuggccggcaccgccaucggcuucaagaucaacagcagagagggcaacuaccugauggacgugaucggcuacgugaagagcgccagcuacagcgccguguacaccaagcuguacaccaccggccccaccaucggcaucaacaccaagcacgacgagaagugcaccggccccugccccgccaucaucgaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagagugaucgccaucaagaaccacgagaucaaggugggccagaucaacgaccugggcguguacagcaagggcugcggcaacgugcagaaggugaacggcaccaacuacggcaacggcagccccagauucgacuaccugugccaccuggccagcagaaaggaggugauccugagaaagugcuucgacaacgacuaccaggccugcaaguuccugcagagccccagcagcuacagacuggaggagcaccagggcaccgugaccgugaucgacuacaagaagauccugggcaccaucaagaugaaggccauccugggcgacgugaaguacaagaacuaccagaacaacaucgagaucaacgccgagggcaccugcgccggcugcaucgacugcuucgagaacauccacugcgaguucaccauccacaccaccguggaggccagcugccccaucaccaccgagugcgugagcuuccacgacagaauccugaucacccccgacgagcacaaguacgcccugaagaucgugugccacgacaagcccaaggugagccugaaguucaagaucugcaacaccaacguggacgccgccaugaccaucguggacagcaagcccauccuggagcuggcccccguggaccagaccaccuacaucagagagaaggacgagagaugcaagaccuggaugugcagagugagagacgagggcuuccaggugauccuggagcccuucaagaaccuguucggcagcuacaucggcaucuucuacaccggcauccugagcaucaucugccugcugaucgugguguacaucauccugcccaucugcuucaagcugagagacacccugagacagcacgaggacgccuacaagaaggagaugaagaucagauga

SEQ ID NO: 9361 - RNA, 4335 nt, Artificial Sequence
  derived and/or modified CDS sequence (opt4) from JCV(61V2235)__KX817316.1__GP
auggaggugcugaaccugaucuggcugcuggcccugugcagcgccagccccguguuccagagaugcuuccaggacggcgccaucgugaagcagaaccccagcaaggaggccgugaccgaggugugccugaaggacgacgugagcaugaucaagaccgaggccaaguacgugaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugagccuggugaucuucaucuuccugagcaucgugagcaagaccuacgugugcuaccugcugaugcccaucuucauccccaucgccuucaucuacggcuggguguacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaugaccgccauccugauccugaccuucgugacccccaucagcgccauggugaucggcgagagcagcgagguguacacccuggacgaccugcccaacgacauggugcagauggccgagagagugaacaucuacuaccagaucaucaucaucaacuacggcgugaccugggccuuccugcugcugggccugauccuggccuacuucuucaagaaguaccagcacaaguuccuggacuucuacgccauguacugcgaggagugcgacauguaccacgagaagagcggccugacccacuggggcgacuucaccaacaagugcagacagugcaccugcggccaguucgaggacguggccggccugaugauccacaagaagagcuacaacugccuggugaaguacaaggccaaguggaucagagacauccugaucaucuaccuggccaugauccugaucaaggacagccugcuguucgugggcgccagcggcaccgacuucgccgccugcaucgacgagaagguggugaccuggaacugcaccggccccuuccugaaccugggcagaugcgacaagagccacaagaaggccagcuacgccggcaucgccgaccagcugaagggccugggcgugaucagcgugcuggacauccccaugaucaagaacaugcccgacgagaucagcggcagccugaaguacaucgacagccuggagaccuaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaaguacggcgacaagugcaacagcgccaagugggacuucgccaacgagaugaagaccuucuacaccggccagaaggugaaguucaacaaggaccugaaccuggcccugcuggugcugcacaaggccuucagaggcaccggcaccgccuacguggccgaggccauggccagaaaggacaacggcagcauggcccacuucgcccuggagaucagaaagaaguuccccaccaacgcccugcuggccgcccugaucgacuacaucguguaccugcagagccugggcgagaucgccaccuucgagcuggacgaggacugggagggcuucaaguacaagcccgagcccaccgagagcaccccccaggugagaagccacagaaacgaccaguacaacuucaagaacgccgagagcaacagcgacaccaaggugugcaagaacgugcagaaggugcugugcaucagccccagaagcaaggccaaguucaagaacaucaucgccugcggcgagcacgccaaccccagcguguacaugaugcccaacgugagcaucuaccagagcaacagcgagagaagccacuacugcaucgccgacagccacugccuggagaaguacgaggugguggagaccgagcugcugaacgcccugaagaagagcaagugcugggccaaggagauggacgacaucauccugcacaagcagagcgacggccugagaagcugcagaaucaaggacaccggcaacugcaacgugcaggagaacgacuggaccaucgugcugugcgagaacggcaacuacuacuacagcgaggugcacaaggacuacgacaaggaccaggacgugggccacuucugccugagccccagaugcaccaccaucagauaccccaucagcaagagacacaucaagaagugcgaguggcagaucagccacagcaccaucgacaagaucagcgugcaggagcuggccgacaucgagcaguacaagaaggccaucagccagaagcugcagaccagccugagcaucuucaaguacgugagaaccaagaaccugccccacaucaagcccgccuacaaguacaucaccguggagggcguggagaccaucgagggcaucgagaacgccuucaucgagagcgagauccccgcccuggccggcaccgccaucggcuucaagaucaacagcagagagggcaacuaccugauggacgugaucggcuacgugaagagcgccagcuacagcgccguguacaccaagcuguacaccaccggccccaccaucggcaucaacaccaagcacgacgagaagugcaccggccccugccccgccaucaucgaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagagugaucgccaucaagaaccacgagaucaaggugggccagaucaacgaccugggcguguacagcaagggcugcggcaacgugcagaaggugaacggcaccaacuacggcaacggcagccccagauucgacuaccugugccaccuggccagcagaaaggaggugauccugagaaagugcuucgacaacgacuaccaggccugcaaguuccugcagagccccagcagcuacagacuggaggagcaccagggcaccgugaccgugaucgacuacaagaagauccugggcaccaucaagaugaaggccauccugggcgacgugaaguacaagaacuaccagaacaacaucgagaucaacgccgagggcaccugcgccggcugcaucgacugcuucgagaacauccacugcgaguucaccauccacaccaccguggaggccagcugccccaucaccaccgagugcgugagcuuccacgacagaauccugaucacccccgacgagcacaaguacgcccugaagaucgugugccacgacaagcccaaggugagccugaaguucaagaucugcaacaccaacguggacgccgccaugaccaucguggacagcaagcccauccuggagcuggcccccguggaccagaccaccuacaucagagagaaggacgagagaugcaagaccuggaugugcagagugagagacgagggcuuccaggugauccuggagcccuucaagaaccuguucggcagcuacaucggcaucuucuacaccggcauccugagcaucaucugccugcugaucgugguguacaucauccugcccaucugcuucaagcugagagacacccugagacagcacgaggacgccuacaagaaggagaugaagaucagauga

SEQ ID NO: 9362 - RNA, 4335 nt, Artificial Sequence
  derived and/or modified CDS sequence (opt4) from JCV(3573-03)__HM007354.1__GP
auggaggugcugagccugaucuggcugcugacccugugcagcgccagccccguguuccagagaugcuuccaggacggcgccaucgugaagcagaaccccagcaaggaggccgugaccgaggugugccugaaggacgacgugagcaugaucaagaccgaggccaaguacgugaagaacaccaccggcaccuucgccaacaacaucgccaugagaaaguggcugguggccgacuggcacgacugcagaccccagaagagcagcggcggccacaucaacgugaucgaggugggcgacgaccugagccugcacaccgagagcuacaucugcagcgccgacugcgugaucaccguggacaaggagaccgcccagaucagacugcagaccgacaacaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccagcagcaucgccaacagcaucugccagaacaucgagaucaucauccuggugacccugagccugaccaucuucaucuuccugaccaucgugagcaagaccuacaucugcuaccugcugaugcccguguucauccccaucgccuucguguacggcuggaucuacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcaucaugaccgccgugcugauccugaccuucgugacccccaucagcgccaugaugaucggcgagagcagcgagguguacacccuggacgaccugcccgacgacauggugcagauggccgagagagugaacaucuacuaccagaucaucaucaucaacuacggcgugaccugggccuuccugcugcugggccuggugcuggccuacuucuucaagaaguaccagcacaaguuccuggacuucuacgccauguacugcaacgagugcgacauguaccacgagaaggccggccugacccacuggggcgacuucaccaacagaugcagacagugcaccugcggccaguacgaggacgugaccggccugaucgugcacaagaagagcuacaacugccuggugaaguacaaggccaaguggaucagagacauccugaucaccuaccugaucaucauccuggugaaggacagccugcuguucgugggcgccaccggcaccgacuucgccgccugcaucgacgagaagaccgugaccuggaacugcaccggccccuuccugaaccugggcagaugcgacaagagccagaagaagaccagcuacaacgacaucgccaaccagcugaagggccugggcgugaucagcgugcuggacauccccaugaucaagagaaugcccgacgagaucagcggcagccugaaguacaucgacaaccuggagaccuaccacgagcagcugaccgccgaguacgccuuccugaccagauacugcgacuacuacacccaguacaccgacaacagcggcuacagccagaccguguggagaaccuaccugagaagccacgacuucggcgccugcgugguguaccccaaccagcacuucugcagaugcgugaaguacggcgacaagugcaacagcgccaagugggacuucgccaacgagaugaagaccuucuacaccggccagaagaucaaguucaacaaggaccugaaccuggcccugcuggugcugcacaaggccuucagaggcaccggcaccgccuacaucgccgaggccauggccagaaaggacaacggcagcauggcccacuucgcccuggaggugagaaagaaguuccccaccaacgcccugcuggccgcccugaucgacuacaucguguaccugcagagccuggccgagaucagcaccuucgagcuggacgaggacugggaggacuucaaguacaagcccgagcccaccgagagccccagccaggccagaagccacagaagcgaccaguacaacuucaagaacgccgagagcaacagcaacgugaaggugugcaagaacauccagaaggugcugugcaucagccccagaagcagagccaaguucgagaacaucaucgccugcggcgagcacgccaaccccagcguguacaugaugcccaacgugagcaucuaccagagcaacagcgagagaagccacuacugcaucgccgacagccacugccuggaggacuacgagaucguggagaccgagcugcugagcgcccugaagaagagcaagugcugggccaaggagauggacgacaucgugcugcacaagcagagcgacggccugagaagcugcagaaugaaggacaccggcaacugcgacgugcaggagaacgacuggaccaucgugcugugcgagaacggcaacuacuacuacagcgagauccacaaggacuacgacaaggaccaggacgugggccacuucugccugagccccagaugcagcaccaucagauaccccaucaacaagagacacaucaagagaugcaacuggcagaucagccacagcaccaucgacaagaucagcgugcaggagcuggccgacaucgagcaguacaagaaggccaucagccagaagcugcagaccagccugagcaucuucaaguacgugaagaccaagaaccugccccacaucaagcccgccuacaaguacaucaccguggagggcaucgagaccguggagggcaucgagaacgccuucaucgagagcgagauccccgcccuggccggcaccgccaucggcuucaagaucaacagcagagagggcaacuaccugauggacgugaucggcuacgugaagagcgccagcuacagcgccaccuacaccaagcuguacaccaccggccccaccaucggcaucaacaccagacacgacgagaagugcaccggccccugccccgccgugaucgaccacaaggacggcuggcugaccuucagcaaggagagaaccagcaccuggggcugcgaggaguucggcugccuggccgugagcgacggcugcguguucggcagcugccaggacaucaucaaggacgagcuggccguguacagaaagaccaccgaggagcugaccaccguggagcugugccugaccuucagcgacaagaccuacugcaccaaccugaacgccaucacccccaucaucaccgacaaguucgaggugcaguucaagaccguggagagcuacacccugcccagagugaucgccgugaagaaccacgagaucaaggugggccagaucaacgaccugggcguguacagcaagggcugcggcaacgugcagaaggugaacggcaccaacuacggcaacggcaugcccaaguucgacuaccugugccaccuggccagcagaaaggaggugauccugagaaagugcuucgacaacgacuaccaggccugcaaguuccugcagagccccagcagcuacagacuggaggagcaccagggcaccgugaccaucaucgacuacaagaagauccugggcaccaucaagaugaaggccauccugggcgacgugaaguacaagaacuaccagagcaacaucgagaucaacgccgagggcaccugcgccggcugcaucaacugcuucgagaacauccacugcgaguucaccauccacaccaccguggaggccagcugccccaucgugaccgacugcgugagcuuccacgacagaauccugaucacccccgacgagcacaaguacgcccugaagguggugugccaggacaagcccaaggugagccugaaguucaagaucugcaacaccaacaucgacgccagcaugaccaucguggacagcaagcccauccuggagcuggcccccguggaccagaccgccuacaucaaggagaaggacgagagaugcaagaccuggaugugcagagugagagacgagggcuuccaggugauccuggagcccuucaagaaccuguucggcagcuacaucggcaucuucuacaccggcauccugagcgugaucugccugcugaucgugaucuacaucauccugcccaucugcuucaagcugagagacacccugagacagcacgaggacgccuacaagaaggagaugaagaucagauga

SEQ ID NO: 9363 - RNA, 4335 nt, Artificial Sequence
  derived and/or modified CDS sequence (opt4) from KEYV(KEYV/Ochlerotatus atlanticus/USA/KEYVLK01/2005)__KT630289.1__GP
augaugaucuggauccugcugaccguggugaccgugaccaucgccaaccccguguaccagagaugcuuccaggacggcgccaucgugaagcagaaccccagcaaggaggccgugaccgaggugugccugaaggacgacgugagcaugaucaagaccgaggccaaguacgugaagaaccugaccggcaccuucagcaacaacguggccaugagaaaguggcugguggccgacuggcacgacugcagaccccagaagagagccggcggccacaucaacgugaucgaggugggcgacgaccugagccugcacaccgagagcuacaucugcagcgccgacugcgugaucagcguggacaaggagaccgcccagaucagacugcagaccgacaccaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuacauccugaugcccaucuucauccccaucgccuacaucuacggcuggguguacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcauccugaccgccgugcugauccugaccuucaucacccccaugaacgccauggugcugggcagcagcgaggagguguacaagcuggaggaccugcccgacgacaugcugaacauggccgagaagaucgacaucuacuaccugagcaucgugcugaacuacagcaccaccuggggccugcugauccugcugcugaucgugagcugccuguucaagaaguaccagcacguguuccugaacuacuacgccauguacugccacgagugcgacauguaccacgagaagaagaaccugguguacaacggcgacuucagcaacaagugcagacagugcaccugcggccaguacgaggacgccaccggccugaucgugcaccagaagagcuacaacugccugaucaaguacaaggccaagugguucaucaacauccugaucaucuacaccauccuggugcugcugaaggacagcgugcugauggccgccgccgagggccccgacuucaacaccugcaucgagcagagaagcaucagccugaacugcaccggccccuucaucaaccugggcggcugcgagaagccccagaagagagccagcuaccagagcaucgccgagcagcugaaggccaucaacgccaucagcauccuggacaugcccaugaucagcaagauccccgacgacaucagcggcgcccugagacacaucgagaaccugaagaccuaccacgagcagcugaccgccgaguucgccaugcugaccagauacugcgacuacuacacccaguucagcgacaacagcggcuacagccagaccagcuggagaaccuaccugagaagccacgacuucgaggugugcaucgccuaccccaaccagcacuucugcagaugcgugaagaacggcgagaagugcaccagcgccaacugggacuucgccaacgagaugaagaacuacuacaccggcaagcagaucagauucgacaaggaccugaaccuggcccugaccacccugcacaccgccuucagaggcaccagcaccuacuacaugagcgacauccuggccgagaccaaggccaacagccugagagacuacgcccuggcccugaagagcaaguaccccggcaacgcccugcugaaggccauccuggacuucaucauguaccugcagagccugaacgaggccaccaaguucaagcugagcagcgacugggaggacuucaaguacaacagcgagcuggaggccagagcccugaugcccagagccagaagcagcggcgacuacaacuucagcaacgccgagagcaccaacaaggugaagaucugcaagaacauccagagagugaugugccugagccccagaagcaaggccaccguggaggacaucaucgccugcggcgagcacgagcaccccagcguguacauggugcccaacaccaccaucuaccagagcaacaucgagagaagccacuacugcaucgccgacagccacugccuggaggaguacgagcuggugcagaacgagcugcugaccgcccugaagaagagcaccugcuggaccggcgagcuggagaacgugaucccccacaagcagagcgacggcaucagaagcugcagaaccaagaacaccggcagaugcaacgugaagggcgaggacuggaccgugauccugugcgagaacgacaaguacuacuacagcgagcugaacaaggacuacgacaaggaccaggacaucggccacgugugccugagccccagaugcaacagcaucagauaccccaucagccccagacacaucaccaacugcaagugggagaaccccgccggcaccaucagcagaaucgagacccacagccuggccgacaucgagcaguacaagaaggccaucagccagaagcugcagaacagccugaccaucuucaaguacgagaagaccaagaaccugccccacaucaagcccaucuacaaguacaucaccaucgagggcaccgagaccguggagggcguggagaacgccuucaucgaggccgagauccccgcccuggccggcaccagcaucggcuucaaggugaacagcagagacggcgaccaccugauggacaucaucgccuacaucaagguggccagcuacagcagcaccuacaccaagcuguacaccaccggccccaccaucggcaucaacaccaagcacgacgagaagugcaccggcaacugccccgccagacuggagcacaaggugggcuggcugaccuucgccaaggagagaaccagcaccuggggcugcgaggaguucggcugccuggccgugagcgacggcugcguguucggcagcugccaggacaucaucaaggaggagcugagcguguacagaaaggacaccgaggaggugagcaacguggagcugugccugaccuucgccgacaagaccuacugcaccagccugaacgccaucacccccaucaucaccgagaaguucgaggugcaguucaagaccguggagagcuacagccugcccagaaucgugggcaucagaaaccacgagaucagaaucggccagaucaacgaccugggcagcuacagcaagggcugcggcaacgugcagagagugaacggcaccaacuacggcagcggccagcccaaguucgacuaccugugccaccuggccagcagaaaggaggugaucgugagaaagugcuucgacaacgacuaccaggccugcaaguuccugcagacccccagcagcuacagacuggaggagcacgagggcaccgugaccaucaucgacuacaagaagauccugggcaccaucaagaugaaggccauccugggcgacgugagauacaagaacuacgccagcgccaucgacaucaacgccgagggcgugugcgccggcugcaucaacugcuucgagaacauccacugcgaguucaccauccacaccaccaucgaggccagcugccccaucgagagcgacugcgugagcuuccacgacagaauccuggugacccccaacgagcacaaguacgcccugaagcugaucugcgaggacaagcccggcagcacccugaaguucaagaucugcaacaccaagaucgacgccgccaugacccugguggacgccaagcccauccuggagcuggcccccguggaccagaccgccuacaucagagagaaggacgagagaugcaagaccuggaugugcagagugagagacgagggcaucaaggugcugcuggagcccuucaagaaccuguucggcagcuacaucggcaucguguacagcaucauccugaucaucaucgccgccaucaucaucaucuacaucauccugcccaucugcuucaagcugagagacacccugaagaagcacgaggacgccuacagaaaggagaugaagaucagauga

SEQ ID NO: 9364 - RNA, 4332 nt, Artificial Sequence
  derived and/or modified CDS sequence (opt4) from KEYV(KEYV/Ochlerotatus atlanticus/USA/KEYVLK01/2005)__KT630289.1__GP
augaucuggauccugcugaccguggugaccgugaccaucgccaaccccguguaccagagaugcuuccaggacggcgccaucgugaagcagaaccccagcaaggaggccgugaccgaggugugccugaaggacgacgugagcaugaucaagaccgaggccaaguacgugaagaaccugaccggcaccuucagcaacaacguggccaugagaaaguggcugguggccgacuggcacgacugcagaccccagaagagagccggcggccacaucaacgugaucgaggugggcgacgaccugagccugcacaccgagagcuacaucugcagcgccgacugcgugaucagcguggacaaggagaccgcccagaucagacugcagaccgacaccaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuacauccugaugcccaucuucauccccaucgccuacaucuacggcuggguguacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcauccugaccgccgugcugauccugaccuucaucacccccaugaacgccauggugcugggcagcagcgaggagguguacaagcuggaggaccugcccgacgacaugcugaacauggccgagaagaucgacaucuacuaccugagcaucgugcugaacuacagcaccaccuggggccugcugauccugcugcugaucgugagcugccuguucaagaaguaccagcacguguuccugaacuacuacgccauguacugccacgagugcgacauguaccacgagaagaagaaccugguguacaacggcgacuucagcaacaagugcagacagugcaccugcggccaguacgaggacgccaccggccugaucgugcaccagaagagcuacaacugccugaucaaguacaaggccaagugguucaucaacauccugaucaucuacaccauccuggugcugcugaaggacagcgugcugauggccgccgccgagggccccgacuucaacaccugcaucgagcagagaagcaucagccugaacugcaccggccccuucaucaaccugggcggcugcgagaagccccagaagagagccagcuaccagagcaucgccgagcagcugaaggccaucaacgccaucagcauccuggacaugcccaugaucagcaagauccccgacgacaucagcggcgcccugagacacaucgagaaccugaagaccuaccacgagcagcugaccgccgaguucgccaugcugaccagauacugcgacuacuacacccaguucagcgacaacagcggcuacagccagaccagcuggagaaccuaccugagaagccacgacuucgaggugugcaucgccuaccccaaccagcacuucugcagaugcgugaagaacggcgagaagugcaccagcgccaacugggacuucgccaacgagaugaagaacuacuacaccggcaagcagaucagauucgacaaggaccugaaccuggcccugaccacccugcacaccgccuucagaggcaccagcaccuacuacaugagcgacauccuggccgagaccaaggccaacagccugagagacuacgcccuggcccugaagagcaaguaccccggcaacgcccugcugaaggccauccuggacuucaucauguaccugcagagccugaacgaggccaccaaguucaagcugagcagcgacugggaggacuucaaguacaacagcgagcuggaggccagagcccugaugcccagagccagaagcagcggcgacuacaacuucagcaacgccgagagcaccaacaaggugaagaucugcaagaacauccagagagugaugugccugagccccagaagcaaggccaccguggaggacaucaucgccugcggcgagcacgagcaccccagcguguacauggugcccaacaccaccaucuaccagagcaacaucgagagaagccacuacugcaucgccgacagccacugccuggaggaguacgagcuggugcagaacgagcugcugaccgcccugaagaagagcaccugcuggaccggcgagcuggagaacgugaucccccacaagcagagcgacggcaucagaagcugcagaaccaagaacaccggcagaugcaacgugaagggcgaggacuggaccgugauccugugcgagaacgacaaguacuacuacagcgagcugaacaaggacuacgacaaggaccaggacaucggccacgugugccugagccccagaugcaacagcaucagauaccccaucagccccagacacaucaccaacugcaagugggagaaccccgccggcaccaucagcagaaucgagacccacagccuggccgacaucgagcaguacaagaaggccaucagccagaagcugcagaacagccugaccaucuucaaguacgagaagaccaagaaccugccccacaucaagcccaucuacaaguacaucaccaucgagggcaccgagaccguggagggcguggagaacgccuucaucgaggccgagauccccgcccuggccggcaccagcaucggcuucaaggugaacagcagagacggcgaccaccugauggacaucaucgccuacaucaagguggccagcuacagcagcaccuacaccaagcuguacaccaccggccccaccaucggcaucaacaccaagcacgacgagaagugcaccggcaacugccccgccagacuggagcacaaggugggcuggcugaccuucgccaaggagagaaccagcaccuggggcugcgaggaguucggcugccuggccgugagcgacggcugcguguucggcagcugccaggacaucaucaaggaggagcugagcguguacagaaaggacaccgaggaggugagcaacguggagcugugccugaccuucgccgacaagaccuacugcaccagccugaacgccaucacccccaucaucaccgagaaguucgaggugcaguucaagaccguggagagcuacagccugcccagaaucgugggcaucagaaaccacgagaucagaaucggccagaucaacgaccugggcagcuacagcaagggcugcggcaacgugcagagagugaacggcaccaacuacggcagcggccagcccaaguucgacuaccugugccaccuggccagcagaaaggaggugaucgugagaaagugcuucgacaacgacuaccaggccugcaaguuccugcagacccccagcagcuacagacuggaggagcacgagggcaccgugaccaucaucgacuacaagaagauccugggcaccaucaagaugaaggccauccugggcgacgugagauacaagaacuacgccagcgccaucgacaucaacgccgagggcgugugcgccggcugcaucaacugcuucgagaacauccacugcgaguucaccauccacaccaccaucgaggccagcugccccaucgagagcgacugcgugagcuuccacgacagaauccuggugacccccaacgagcacaaguacgcccugaagcugaucugcgaggacaagcccggcagcacccugaaguucaagaucugcaacaccaagaucgacgccgccaugacccugguggacgccaagcccauccuggagcuggcccccguggaccagaccgccuacaucagagagaaggacgagagaugcaagaccuggaugugcagagugagagacgagggcaucaaggugcugcuggagcccuucaagaaccuguucggcagcuacaucggcaucguguacagcaucauccugaucaucaucgccgccaucaucaucaucuacaucauccugcccaucugcuucaagcugagagacacccugaagaagcacgaggacgccuacagaaaggagaugaagaucagauga

SEQ ID NO: 9365 - RNA, 4332 nt, Artificial Sequence
  derived and/or modified CDS sequence (opt4) from KEYV(KEYV/Ochlerotatus atlanticus/USA/KEYVLK02/2005)__KT630292.1__GP
augaucuggauccugcugaccguggugaccgccaccaucgccaaccccguguaccagagaugcuuccaggacggcgccaucgugaagcagaaccccagcaaggaggccgugaccgaggugugccugaaggacgacgugagcaugaucaagaccgaggccaaguacgugaagaaccugaccggcaccuucagcaacaacguggccaugagaaaguggcugguggccgacuggcacgacugcagaccccagaagagagccggcggccacaucaacgugaucgaggugggcgacgaccugagccugcacaccgagagcuacaucugcagcgccgacugcgugaucagcguggacaaggagaccgcccagaucagacugcagaccgacaccaccaaccacuucgagguggccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuacauccugaugcccaucuucauccccaucgccuacaucuacggcuggguguacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcauccugaccgccgugcugauccugaccuucaucacccccaugaacgccauggugcugggcagcagcgaggagguguacaagcuggaggaccugcccgacgacaugcugaacauggccgagaagaucgacaucuacuaccugagcaucgugcugaacuacagcaccaccuggggccugcugauccugcugcugaucgugagcugccuguucaagaaguaccagcacguguuccugaacuacuacgccauguacugccacgagugcgacauguaccacgagaagaagaaccugguguacaacggcgacuucagcaacaagugcagacagugcaccugcggccaguacgaggacgccaccggccugaucgugcaccagaagagcuacaacugccugaucaaguacaaggccaagugguucaucaacauccugaucaucuacaccauccuggugcugcugaaggacagcgugcugauggccgccgccgagggccccgacuucaacaccugcaucgagcagagaagcaucagccugaacugcaccggccccuucaucaaccugggcggcugcgagaagccccagaagagagccagcuaccagagcaucgccgagcagcugaaggccaucaacgccaucagcauccuggacaugcccaugaucagcaagauccccgacgacaucagcggcgcccugagacacaucgagaaccugaagaccuaccacgagcagcugaccgccgaguucgccaugcugaccagauacugcgacuacuacacccaguucagcgacaacagcggcuacagccagaccagcuggagaaccuaccugagaagccacgacuucgaggugugcaucgccuaccccaaccagcacuucugcagaugcgugaagaacggcgagaagugcaccagcgccaacugggacuucgccaacgagaugaagaacuacuacaccggcaagcagaucagauucgacaaggaccugaaccuggcccugaccacccugcacaccgccuucagaggcaccagcaccuacuacaugagcgacauccuggccgagaccaaggccaacagccugagagacuacgcccuggcccugaagagcaaguaccccggcaacgcccugcugaaggccauccuggacuucaucauguaccugcagagccugaacgaggccaccaaguucaagcugagcagcgacugggaggacuucaaguacaacagcgagcccgaggccagagcccugaugcccagagccagaagcagcggcgacuacaacuucagcaacgccgagagcaccaacaaggccaaggugugcaagaacauccagagagugaugugccugagccccagaagcaaggccaccguggaggacaucaucgccugcggcgagcacgagcaccccagcguguacauggugcccaacaccaccguguaccagagcaacaucgagagaagccacuacugcaucgccgacagccacugccuggaggaguacgagcuggugcagaacgagcugcugaccgcccugaagaagagcaccugcuggaccggcgagcuggagaacgugaucccccacaagcagagcgacggcaccagaagcugcagaaccaagaacaccggcagaugcaacgugaagggcgaggacuggaccgugauccugugcgagaacgacaaguacuacuacagcgagcugaacaaggacuacgacaaggaccaggacaucggccacgugugccugagccccagaugcaacagcaucagauaccccaucagccccagacacaucaccaacugcaagugggagaaccccgccggcaccaucagcagaaucgagacccacagccuggccgacaucgagcaguacaagaaggccaucagccagaagcugcagaacagccugaccaucuucaaguacgagaagaccaagaaccugccccacaucaagcccaucuacaaguacaucaccaucgagggcaccgagaccguggagggcguggagaacgccuucaucgaggccgagauccccgcccuggccggcaccagcaucggcuucaaggugaacagcagagacggcgaccaccugauggacaucaucgccuacaucaagguggccagcuacagcagcaccuacaccaagcuguacaccaccggccccaccaucggcaucaacaccaagcacgacgagaagugcaccggcaacugccccgccagacuggagcacaaggugggcuggcugaccuucgccaaggagagaaccagcaccuggggcugcgaggaguucggcugccuggccgugagcgacggcugcguguucggcagcugccaggacaucaucaaggaggagcugagcguguacagaaaggacaccgaggaggugaccaacguggagcugugccugaccuucgccgacaagaccuacugcaccagccugaacgccaucacccccaucaucaccgagaaguucgaggugcaguucaagaccguggagagcuacagccugcccagaaucgugggcaucagaaaccacgagaucagaaucggccagaucaacgaccugggcagcuacagcaagggcugcggcaacgugcagagagugaacgacaccaacuacggcagcggccagcccaaguucgacuaccugugccaccuggccagcagaaaggaggugaucgugagaaagugcuucgacaacgacuaccaggccugcaaguuccugcagacccccagcagcuacagacuggaggagcacgagggcaccgugaccaucaucgacuacaagaagauccugggcaccaucaagaugaaggccauccugggcgacgugagauacaagaacuacgccagcgccaucgacaucaacgccgagggcgugugcgccggcugcaucaacugcuucgagaacauccacugcgaguucaccauccacaccaccaucgaggccagcugccccaucgagagcgacugcgugagcuuccacgacagaaugcuggugacccccaacgagcacaaguacgcccugaagcugaucugcgaggacaagcccggcagcacccugaaguucaagaucugcaacaccaagaucgacgccgccaugacccugguggacgccaagcccauccuggagcuggcccccguggaccagaccgccuacaucagagagaaggacgagagaugcaagaccuggaugugcagagugagagacgagggcaucaaggugcugcuggagcccuucaagaaccuguucggcagcuacaucggcaucguguacagcaucauccugaucaucaucgccgccaucaucaucaucuacgugauccugcccaucugcuucaagcugagagacacccugaagaagcacgaggacgccuacagaaaggagaugaagaucagauga

SEQ ID NO: 9366 - RNA, 4332 nt, Artificial Sequence
  derived and/or modified CDS sequence (opt4) from KEYV(C14031-33)__AF123489.1__GP
augaucuggauccugcugaccguggugaccgugaccaucgccaaccccguguaccagagaugcuuccaggacggcgccaucgugaagcagaaccccagcaaggaggccgugaccgaggugugccugaaggacgacgugagcaugaucaagaccgaggccaaguacgugaagaaccugaccggcaccuucagcaacaacguggccaugagaaaguggcugguggccgacuggcacgacugcagaccccagaagagagccggcggccacaucaacgugaucgaggugggcgacgaccugagccugcacaccgagagcuacaucugcagcgccgacugcgugaucagcguggacaaggagaccgcccagaucagacugcagaccgacaccaccaaccacuucgagguggccggcaccaccgugaagagcggcugguucaagagcaccaccuacaucacccuggaccagaccugcgagagacugaaggugagcugcggccccaagagcauccaguuccacgccugcuucaaccagcacaugagcugcgugagauuccugcacagaaccauccugcugggcagcaucgccaacagcaucugccagaacaucgagaucaucauccuggugacccugacccugcugaucuucauccugcugagcauccugagcaagaccuacaucugcuacauccugaugcccaucagcauccccaucgccuacaucuacggcuggguguacaacaagagcugcaagaagugcaagcugugcggccugguguaccaccccuucaccgagugcggcacccacugcgugugcggcgccagauacgagaccagcgacagaaugaagcugcacagagccagcggccugugccccggcuacaagagccugagagccgccagagugaugugcaagagcaagggccccgccagcauccugagcauccugaccgccgugcugauccugaccuucaucacccccaugaacgccauggugcugggcagcagcgaggagguguacaagcuggaggaccugcccgacgacaugcugaacauggccgagaagaucgacaucuacuaccugagcaucgugcugaacuacagcaccaccuggggccugcugauccugcugcugaucgugagcugccuguucaagaaguaccaccugguguuccugaacuacuacgcccuguacugccacgagugcgacauguaccacgagaagaagaaccugguguacaacggcgacuucagcaacaagugccugcagugcaccugcggccaguacgaggacgccaccggccugaucgugcaccagaagagcuacaacugccugaucaacuacaaggccaagugguucaucaacauccugaucaucuacaccauccuggugcugcugaaggacagcgugcugauggccgccgccgagagacccgacuucaacaccugcaucgagcagagaagcaucagccugaacugcaccggccccuucaucaaccugggcggcugcaagaagccccagaagagagccagcuaccagagcaucgccgagcagcugaaggccaucaacgccaucagcauccuggacaugcccaugaucagcaagauccccgacgacaucagcggcgcccugagacacaucgagaaccugaagaccuaccacgagcagcugaccgccgaguucgccaugcugaccagauacugcgacuacuacacccaguucagcgacaacagcggcuacagccagaccagcuggagaaccuaccugagaagccacgacuucgaggugugcaucgccuaccccaaccagcacuucugcagaugcgugaagaacggcgagaagugcaccagcgccaacugggacuucgccaacgagaugaagaacuacuacaccggcaagcagaucagauucgacaaggaccugaaccuggcccugaccacccugcacaccgccuucagaggcaccagcaccuacuacaugagcgacauccuggccgagaccaaggccaacagccugagagacuacgcccuggcccugaagagcaaguaccccggcaacgcccugcugaaggccauccuggacuucaucauguaccugcagccccugaacgaggccaccaaguucaagcugagcagcgacugggaggacuucaaguacaacagcgagcccgaggccagagcccugaugcccagagccagaagcagcggcgacuacaacuucagcaacgccgagagcaccaacaaggugaaggugugcaagaacauccagagagugaugugccugagccccagaagcaaggccaccguggaggacaucaucgccugcggcgagcacgagcaccccagcguguacauggugcccaacaccaccaucuaccagagcaacaucgagagaagccacuacugcaucgccgacagccacugccuggaggaguacgagcuggugcagaacgagcugcugaccgcccugaagaagagcaccugcuggaccggcgagcuggagaacgugaucccccacaagcagagcgacggcaucagaagcugcagaaccaagaacaccggcagaugcaacgugaagggcgaggacuggaccgugauccugugcgagaacgacaaguacuacuacagcgagcugaacaaggacuacgacaaggaccaggacaucggccacgugugccugagccccagaugcaacagcaucagauaccccaucagccccagacacaucaccaacugcaagugggagaaccccgccggcaccaucagcagaaucgagacccacagccuggccgacaucgagcaguacaagaaggccaucagccagaagcugcagaacagccugaccaucuucaaguacgagaagaccaagaaccugccccacaucaagcccaucuacaaguacaucaccaucgagggcaccgagaccguggagggcguggagaacgccuucaucgaggccgagauccccgcccuggccggcaccagcaucggcuucaaggugaacagcagagacggcgaccaccugauggacaucaucgccuacaucaagguggccagcuacagcagcaccuacaccaagcuguacaccaccggccccaccaucggcaucaacaccaagcacgacgagaagugcaccggcaacugccccgccagacuggagcacaaggugggcuggcugaccuucgccaaggagagaaccagcaccuggggcugcgaggaguucggcugccuggccgugagcgacggcugcguguucggcagcugccaggacaucaucaaggaggagcugagcguguacagaaaggacaccgaggaggugaccaacguggagcugugccugaccuucgccgacaagaccuacugcaccagccugaacgccaucacccccaucaucaccgagaaguucgaggugcaguucaagaccguggagagcuacagccugcccagaaucgugggcaucagaaaccacgagaucagaaucggccagaucaacgaccugggcagcuacagcaagggcugcggcaacgugcagagagugaacggcaccaacuacggcagcggccagcccaaguucgacuaccugugccaccuggccagcagaaaggaggugaucgugagaaagugcuucgacaacgacuaccaggccugcaaguuccugcagacccccagcagcuacagacuggaggagcacgagggcaccgugaccaucaucgacuacaagaagauccugggcaccaucaagaugaaggccauccugggcgacgugagauacaagaacuacgccagcgccaucgacaucaacgccgagggcgugugcgccggcugcaucaacugcuucgagaacauccacugcgaguucaccauccacaccaccaucgaggccagcugccccaucgagagcgacugcgugagcuuccacgacagaaugcuggugacccccaacgagcacaaguacgcccugaagcugaucugcgaggacaagcccggcagcgcccugaaguucaagaucugcaacaccaagaucgacgccgccaugacccugguggacgccaagcccauccuggagcuggcccccguggaccagaccgccuacaucagagagaaggacgagagaugcaagaccuggaugugcagagugagagacgagggcaucaaggugcugcuggagcccuucaagaaccuguucggcagcuacaucggcaucguguacagcaucauccugaucaucaucgccgccaucaucaucaucuacaucauccugcccaucugcuucaagcugagagacacccugaagaagcacgaggacgccuacagaaaggagaugaagaucagauga

SEQ ID NO: 9367 - RNA, 4326 nt, Artificial Sequence
  derived and/or modified CDS sequence (opt4) from LACV(Human/78)__NC_004109.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagauga

SEQ ID NO: 9368 - RNA, 4326 nt, Artificial Sequence
  derived and/or modified CDS sequence (opt4) from LACV__KP271111.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcgccgacugcagcaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacauguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggccagcagaaucaacagcuacuacuucaccugcauccugaacuacgccgugagcuggggccuggugaucaucggccugcugaccggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagagagaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaaggccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucaaccaggaggagcuggacgccgugaagaagagcaagugcugggagaucgaguacagcgacgugaagccccugcaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccaaggagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaagaucaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucguguacgugcugcugcccaucugcuucaagcugagagacacccugagaaagcacgaggacgccuacaagagagagaugaagaucagauga

SEQ ID NO: 9369 - RNA, 4326 nt, Artificial Sequence
  derived and/or modified CDS sequence (opt4) from LACV__M87664.1__GP
augaucugcauccuggugcugaucaccguggccaccgccagccccgugcugcagagaugcuuccaggacggcgccaucgugaagcagaaccccagcaaggaggccuucaccgaggugugccugaaggacgacgugagcaugaucaagaccgaggccagauacgugagaaacgccaccggcguguucagcaacaacguggccaucagaaaguggcuggugagcgccuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucagaagcaccaccuacaucacccuggaccagaccugcgagcaccugaaggugagcugcggccccaagagcgugcaguuccacgccugcuucaaccagcacaugagcugcgugagauuccugcacagaaccauccugcccagaagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaccaucuacaacaagagcugcaagaagugcaagcugugcggccuggcccaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccccaccugcauccugaacuacgccgugagcuggggccuggugaucaucggccugcugaucggccugcuguucaagaaguaccagcacagauuccugaacguguacgccauguacugcgaggagugcgacauguaccacgacaagagcggcgugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacagagacuucgccaacgagaugaaggacuacuacagcggcaagcagaccaaguucgacaaggaccugaaccuggcccugaccgcccugcacagccaggugaugcacugcagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugacccagugcgagaacgacaaguucuacuacagcgaccugcagaaggacuacgacaagacccaggacaucggccacuacugccugagccccggcugcaccaccgugagauaccccaucaaccccaagcacaucagcaacugcaacuggcaggugagcagaagcagcaucgccgagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaugaagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccaacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9370 - RNA, 4326 nt, Artificial Sequence
  derived and/or modified CDS sequence (opt4) from LACV__KP271105.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcgccgacugcagcaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacauguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggccagcagaaucaacagcuacuacuucaccugcauccugaacuacgccgugagcuggggccuggugaucaucggccugcugaccggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagagagaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaaggccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccagcggccccagcguguacagaaagcccagcggcggcguguuccagagcagcaccgacagaagcaucuacugccugcuggacagccacugccuggaggaguucgaggccaucaaccaggaggagcuggacgccgugaagaagagcaagugcugggagaucgaguacagcgacgugaagccccugcaggagggcgacggcaccaagagcugcaagaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccaaggagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucguguacgugcugcugcccaucugcuucaagcugagagacacccugagaaagcacgaggacgccuacaagagagagaugaagaucagauga

SEQ ID NO: 9371 - RNA, 4326 nt, Artificial Sequence
  derived and/or modified CDS sequence (opt4) from LACV(74-32813)__D10370.1__GP
augaucagaaugcuggugcugaucguggugaccgccgccagccccguguaccagagaugcuuccaggacggcgccaucgugaagcagaaccccagcaaggaggccgugaccgaggugugccugaaggacgacgugagcaugaucaagaccgaggccagauacgugaagaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcgcccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacauguacggcgugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggcccugagaaucaacagcuacuacuucaccugcauccugaacuacgccgugagcuggggccugaucaucgccggccugcuggugggccugaucuucaagaaguaccagcacagauuccugaacaucuacgccauguacugcgaggagugcaacauguaccacgacaagagcggccugaagagacacggcgacuucaccaacaagugcagacagugcaccugcggccaguacgaggacgccaccggccugaucacccacagaaagaccuacaacugccuggugcaguacaaggccaaguggaugaugaacuuccugaucaucuacaucuuccugauccugaucaaggacagcgccaucgugggccaggccaccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccagcauccccgacgacaucgccggcgcccugagauacaucgaggagaaggaggacuuccacgugcagcugaccaccgaguacgccaugcugagcaaguacugcgacuacuacacccaguucagcgacaacagcggcuacagccagaccaccuggagaguguaccugagaagccacgacuucgaggccugcauccuguaccccaaccagcacuucugcaagugcgugaagaacggcgagaagugcagcagcagcaacugggacuucgccaacggcaugaagaacuacuacagcggcaagcaggccaaguucgacaaggaccugaaccuggcccugaccgcccugcaccacgccuucagaggcaccagcagcgccuacaucgccgccaugcugagcaagaagagcaacgacgaccugaucgccuacaccaacaagaucaaggccaaguuccccggcaacgcccugcugaaggccaucaucgacuacaucgccuacaugaagggccugcccgagauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacagcagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugagaccccugcaggagagcgacggcgccaagagcugcagaaugaaggacagcggcaacugcaacguggccaccaacagauggcccgugaugcagugcgagaacgacaaguucuacuacagcgagcugcagaaggacuacgacaagacccaggacaucggccacuacugccugagccccggcugcaccaccaucagauaccccaucaaccccaagcacaucagcaacugcaacuggcaggugagcagaagcagcaucgccaagaucgacgugcacaacguggaggacaucgagcaguacaagaaggccaucacccagaagcugcagaccagccugagccuguucaaguacgccaagaccaagaaccugccccacaucagacccaucuacaaguacaucaccaugaaggagaccgagaccgccgagggcaucgagagcgccuacaucgagagcgaggugcccgcccuggccggcaccagcgugggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccaacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcgccggcugcaucaacugcuuccagaacauccacugcgagcugacccugcacaccaccaucgaggccagcugccccaucaagagcagcugcaccguguuccacgacagaauccuggugacccccaacgagcacaaguacgcccugaagaucgugugcaccgagaagcccggcaacacccugaccaucaaggugugcaacaccagaaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucaucgcccugcuggugaucaucuacgugcugcugcccaucugcuucaagcugagagacacccugagaaagcacgacgacgccuacaagagagagaugaagaucagauga

SEQ ID NO: 9372 - RNA, 4326 nt, Artificial Sequence
  derived and/or modified CDS sequence (opt4) from LACV(Craig County/VA/2009)__KP226848.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccguguucauccccaucgccugcaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggccagcagaaucaacagcuacuacuucaccugcauccugaacuacgccgugagcuggggccuggugaucaucggccugcugaucggccugcuguucaagaaguaccagcacagauuccugaacaucuacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaucaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagagagaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacggcaugaaggacuacuacagcggcaagcaggccaaguucgacaaggaccugaaccuggcccugaccgcccugcaccacgccuucagaggcaccagcagcgccuacaucgccaccaugcugagcaagaagagcaacgacgaccugaucaccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugaagccccugcaggagagcgacggcaccaagagcugcagaaugaaggacagcggcaacugcaacguggccaccaacagauggcccaucauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcgccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggccauccuggugaucaucuacgugcugcugcccaucugcuucaagcugagagacacccugagaaagcacgaggacgccuacaagagagagaugaagaucagauga

SEQ ID NO: 9373 - RNA, 4326 nt, Artificial Sequence
  derived and/or modified CDS sequence (opt4) from LACV(Dallas/TX/2009)__GU591165.1__GP
augaucagaauccuggugcugaucguggugaccgccgccagccccguguaccagagaugcuuccaggacggcgccaucgugaagcagaaccccagcaaggaggccgugaccgaggugugccugaaggacgacgugagcaugaucaagaccgaggccagauacgugaagaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccauggccuacauguacggcgugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggcccugagaaucaacagcuacuacuucaccugcauccugaacuacgccgugagcuggggccugaucaucgccggccugcuggugggccugaucuucaagaaguaccagcacagauuccugaacaucuacgccauguacugcgaggagugcgacauguaccacgacaagagcggccugaagagacacggcgacuucaccagcaagugcagacagugcaccugcggccaguacgaggacgccaccggccugaucacccacagaaagaccuacaacugccuggugcaguacaaggccaaguggaugaugaacuuccugaucaucuacaucuuccugauccugaucaaggacagcgccaucguggugcaggccaccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagaaggaggacuuccacgugcagcugaccaccgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaagaacuacuacagcggcaagcaggccaaguucgacaaggaccugaaccuggcccugaccgcccugcaccacgccuucagaggcaccagcagcgccuacaucgccaccaugcugagcaagaagagcaacgacgaccugguggccuacaccaacaagaucaaggccaaguuccccggcaacgcccugcugaaggccaucaucgacuacaucgccuacaugaagggccugcccgacauggccaacuucaaguacgacgaguucugggacgagcugcuguacaagcccaaccccgccaaggccagcaaccuggccagaggcaaggagagcagcuacaacuucaagcuggccgugagcagcaagagcaucagaaccugcaagaacgugaaggacguggccugccugagccccagaagcggcgccaucuacagcagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacaucagaccccugcaggagagcgacggcagcaagagcugcagaaugaaggacagcggcaacugcaacguggccaccaacagauggcccgugaugcagugcgagaacgacaaguucuacuacagcgagcugcagaaggacuacgacaagacccaggacaucggccacuacugccugagccccggcugcaccaccaucagauaccccaucaaccccaagcacaucagcaacugcaacuggcaggugagcagaagcagcaucgccaagaucgacgugcacaacguggaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggacaccgaggaggugaccaacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcgccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccagaaucgaggugagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucaucgcccugcuggugaucaucuacgugcugcugcccaucugcuucaagcugagagacacccugagaaagcacgacgacgccuacaagagagagaugaagaucagauga

SEQ ID NO: 9374 - RNA, 4326 nt, Artificial Sequence
  derived and/or modified CDS sequence (opt4) from LACV(Fort Bend County/TX/2009)__GU591168.1__GP
augaucagaaugcuggugcugaucguggugaccgccgccagccccguguaccagagaugcuuccaggacggcgccaucgugaagcagaaccccagcaaggaggccgugaccgaggugugccugaaggacgacgugagcaugaucaagaccgaggccagauacgugaagaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcagaaccuacaucugcuaccugcugaugcccaucuucauccccaucgccuacauguacggcgugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggcccugagaaucaacagcuacuacuucaccugcauccugaacuacgccgugagcuggggccugaucaucgccggccugcuggugggccugaucuucaagaaguaccagcacagauuccugaacaucuacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccaccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagaaggaggacuuccacauccagcugaccaccgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaagaacuacuacagcggcaagcaggccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaaggccaaguuccccggcaacgcccugcugaaggccaucaucgacuacaucgccuacaugaagggccugcccgacauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacagcagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugagaccccugcaggagagcgacggcgccaagagcugcagaaugaaggacagcggcaacugcaacguggccaccaacagauggcccgugaugcagugcgagaacgacaaguucuacuacagcgagcugcagaaggacuacgacaagacccaggacaucggccacuacugccugagccccggcugcaccaccaucagauaccccaucaaccccaagcacaucagcaacugcaacuggcaggugagcagaagcagcaucgccaagaucgacgugcacaacguggaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccaacguggagcugugccugaccuucagcgacaagaccuacugcaccagccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcgccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccagaaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucaucgcccugcuggugaucaucuacgugcugcugcccaucugcuucaagcugagagacacccugagaaagcacgacgacgccuacaagagagagaugaagaucagauga

SEQ ID NO: 9375 - RNA, 4326 nt, Artificial Sequence
  derived and/or modified CDS sequence (opt4) from LACV(LAC22988-89)__U18980.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacaacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaucugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaaggcccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagguggaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggugcugcuggugaucaucuacgugcugcugcccaucugcuucaagcugagagacacccugagaaagcacgaggacgccuacaagagagagaugaagaucagauga

SEQ ID NO: 9376 - RNA, 4326 nt, Artificial Sequence
  derived and/or modified CDS sequence (opt4) from LACV(LAC30928-31)__U18979.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaccaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacagagacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaucugcaagaacgugaaggacguggccugccugagccccagaagcggcgccaucuacgccagcaucaucgccugcggcgagcccaacggccccagcguguacagaaagcccagcggcggcguguuccagagcagcaccgaccccagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9377 - RNA, 4326 nt, Artificial Sequence
  derived and/or modified CDS sequence (opt4) from LACV(LAC76-40)__U70206.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaaggacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9378 - RNA, 4326 nt, Artificial Sequence
  derived and/or modified CDS sequence (opt4) from LACV(LAC79-283)__U70207.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagagaaucaucggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcugggcauggccagcagaaucaacagcuacuacuucaccugcauccugaacuacgccgugagcuggggccuggugaucaucggccugcugaccggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccaccggccugauggcccacagaaagaccuacaacugccuggugcaguacaaggccaaguggaugaugaacuuccuggugaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagagagaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuucuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaagcacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugaagccccugcaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaacaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagccccaguacgcccugaagauggugugcaccgagagacccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaugguggcccugcuggugaucaucuacgugcugcugcccaucugcuucaagcugagagacacccugagaaagcacgaggacgccuacaagagagagaugaagaucagauga

SEQ ID NO: 9379 - RNA, 4326 nt, Artificial Sequence
  derived and/or modified CDS sequence (opt4) from LACV(LAC81-4)__U70208.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcugggcauggccagcagaaucaacagcuacuacuucaccugcauccugaacuacgccgugagcuggggccuggugaucaucggccugcugaccggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccaccggccugauggcccacagaaagaccuacaacugccuggugcaguacaaggccaaguggaugaugaacuuccuggugaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagagagaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuucuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaagcacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugaagccccugcaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagccccaguacgcccugaagauggugugcaccgagagacccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaugguggcccugcuggugaucaucuacgugcugcugcccaucugcuucaagcugagagacacccugagaaagcacgaggacgccuacaagagagagaugaagaucagauga

SEQ ID NO: 9380 - RNA, 4326 nt, Artificial Sequence
  derived and/or modified CDS sequence (opt4) from LACV(LACR56869)__U70205.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacaucuacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacauggccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggacggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucgaggugugcaacaccaagaucgaggccagcauggcccugguggacgccaagcccaucaucgagcuggcccccguggaccagaccaccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9381 - RNA, 4326 nt, Artificial Sequence
  derived and/or modified CDS sequence (opt4) from LACV(NAT_Crawford_WI_2007)__GU596383.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggccagcagaaucaacagcuacuacuucaccugcauccugaacuacgccgugagcuggggccuggugaucaucggccugcugaccggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccaccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagagagaggacuuccacgugcagcugaccaucgaguacgccaugcugagcaaguacugcgacuacuacacccaguucagcgacaacagcggcuacagccaggccaccuggagaguguaccugagaagccacgacuucgaggccugcauccuguaccccaaccagcacuucugcagaugcgugaagaacggcgagaagugcagcagcagcaacugggacuucgccaacgagaugaaggacuucuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugaagccccugcaggagagcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagagacccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9382 - RNA, 4326 nt, Artificial Sequence
  derived and/or modified CDS sequence (opt4) from LACV(77)__DQ196119.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucgagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaccaucuacaacaagagcugcaagaagugcaagcugugcggccugguguaccaccccuucaccgagugcggcacccacugcaucugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacagagacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgaccagagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggaggccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9383 - RNA, 4326 nt, Artificial Sequence
  derived and/or modified CDS sequence (opt4) from LACV(LACV/00/NC-M (NC00-283))__GU206112.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacauguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggccagcagaaucaacagcuacuacuucaccugcauccugaacuacgccgugagcuggggccuggugaucaucggccugcugaccggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugaaguacaucgaggagagagaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcaugaccaacuucaaguacgacaaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucaaccaggaggagcuggacgccgugaagaagagcaagugcugggagaucgaguacagcgacgugaagccccugcaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccaaggagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacaacguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccagcgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucauggcccugcuggugaucaucuacgugcugcugcccaucugcuucaagcugagagacacccugagaaagcacgaggacgccuacaagagagagaugaagaucagauga

SEQ ID NO: 9384 - RNA, 4326 nt, Artificial Sequence
  derived and/or modified CDS sequence (opt4) from LACV(LACV/00/WV-M (WV00-3178))__GU206148.1__GP
augaucagaauccuggugcugaucgccaucaccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcagcgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggccagcagaaucaacagcuacuaccugaccugcauccugaacuacgccgugagcuggggccuggugaucaucggccugcugaccggccugcuguucaagaaguaccagcacagauuccugaacaccuacgccauguacugcgaggagugcgacauguaccacgacaagagcggccugaagagacacggcgacuucaccaacaagugcagacagugcaccugcggccaguacgaggacgccgccggccugaugacccacagaaagaccuacaacugccuggugcaguacaaggccaaguggaugaugaacuuccugaucaucuacaucuuccugauccugaucaaggacagcgccaucaucgugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagagagaggacuuccacgugcagcugaccaccgaguacgccaugcugagcagauacugcgacuacuacacccaguucagcgacaacagcagauacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucaccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaagaccagcaaccuggccagaggcaaggagagcaccuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaccgaguaccccgaggugaagccccugcaggagagcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccagaucggcuggcugaccuucgccaaggagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgagagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagagacccggcaacacccugaccaucaaggugugcaacaccaagaucgaggccagcaugacccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9385 - RNA, 4326 nt, Artificial Sequence
  derived and/or modified CDS sequence (opt4) from LACV(LACV/03/NY-M (41030016))__GU206130.1__GP
augaucuacauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccguguucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagguguucgagcuggaggagcugcccgacgacaugcuggagauggcccugagaaucaacuucuacuacuucaccugcauccugaacuacgccgugagcuggagccuggugaucaucggccugcugaccggccugcuguucaagagauaccagcacaaguuccugaacaucuacgccauguacugcgaggagugcgacauguaccacgacaagagcggccugaagagacacggcgacuucaccaacaagugcagacagugcaccugcggccaguacgaggacgccaccggccugaugacccacagaaagaccuacaacugccuggugcaguacaaggccaaguggaucaugaacuuccugaucaucuacaucuuccuggugcugaucaaggacagcgccaucaucgugcaggccgccggcaccgacuucagcagcugccuggagaccgagagcaucaacuggaacugcaccggccccuuccugaaccugggcaacugccagaagcagcagaagaaggagcccuacaccaacaucgccgcccagcugaagggccugagagccaucagcgugcuggacauccccaugaucaccgagauccccgacgacaucgccagcgcccugagauacaucgaggagagagaggccuuccacgugcagcugaccgccgaguacgccaugcugaccagauacugcgacuacuacacccaguucagcgacaacagcggcuacagccagaccaccuggagaguguaccugagaagccacgacuucgaggccugcaucauguaccccaaccagcacuucugcagaugcgugaagaacggcgagaagugcagcagcagcaacugggacuucgccaacgagaugaaggacuacuacagcggcaagcaggccaaguucgacaaggaccugaaccuggcccugaccgcccugcaccacgccuucagaggcaccagcagcgccuacaucgccgccaugcugagcaagaagagcaacgacgaccugaucaccuacaccaacaagaucaagaccaaguuccccggcaacgcccugcugaaggccaucaucgacuacaucgccuacaugaagggccugcccggcauggccagcuucaagcacgacgaguucugggacgagcugcuguacaagcccacccccaccaaggcccccaaccuggccagaggcagagagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcaacggcguguuccagagcagcaccgaccagagcauguacugccugcuggacagccacugccuggaggaguucgaggccaucagccaggaggagcuggacgccgugaagaagagcaagugcugggagaucgaguaccccgacaucaagccccugcaggagagcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccaaggagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccgugaucgacuacaagaagauccugggcaccaucaagaugaaggccauccugggcgacgugaaguacaagaccuucgccgacaacguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagguggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacauccugcugcccaucugcuucaagcugagagacacccugagaaagcacgaggacgccuacaagagagagaugaagaucagauga

SEQ ID NO: 9386 - RNA, 4326 nt, Artificial Sequence
  derived and/or modified CDS sequence (opt4) from LACV(LACV/06/NY(1)-M (06MS2900303))__GU206118.1__GP
augaucuacauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccuggcccugcugaucuucauccugcugagcauccugagcaagaccuacaucugcuaccugcugaugcccguguucauccccaucgccuacguguacggcgugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagguguucgagcuggaggagcugcccgacgacaugcuggagauggcccugagaaucaacuucuacuacuucaccugcauccugaacuacgccgugagcuggagccuggugaucaucggccugcugaccggccugcuguucaagagauaccagcacaaguuccugaacaucuacgccauguacugcgaggagugcgacauguaccacgacaagagcggccugaagagacacggcgacuucaccaacaagugcagacagugcaccugcggccaguacgaggacgccaccggccugaugacccacagaaagaccuacaacugccuggugcaguacaaggccaaguggaucaugaacuuccugaucaucuacaucuuccuggugcugaucaaggacagcgccaucaucgugcaggccgccggcaccgacuucagcagcugccuggagaccgagagcaucaacuggaacugcaccggccccuuccugaaccugggcaacugccagaagcagcagaagaaggagcccuacgccaacaucgccgcccagcugaagggccugaaggccaucagcgugcuggacauccccaugaucaccgagauccccgacgacaucgccagcgcccugagauacaucgaggagagagaggccuuccacgugcagcugaccgccgaguacgccaugcugaccagauacugcgacuacuacacccaguucagcgacaacagcggcuacagccagaccaccuggagaguguaccugagaagccacgacuucgaggccugcaucauguaccccaaccagcacuucugcagaugcgugaagaacggcgagaagugcagcagcagcaacugggacuucgccaacggcaugaaggacuacuacagcggcaagcaggccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagggccugcccggcauggccaacuucaagcacgacgaguucugggacgagcugcuguacaagcccacccccaccaaggcccccaaccuggccagaggcagagagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagccccugaacggcguguuccagagcagcaccgaccagagcauguacugccugcuggacagccacugccuggaggaguucgaggccaucagccaggaggagcuggacgccgugaagaagagcaagugcugggagaucgaguacagcgacaucaagccccugcaggagagcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccaaggagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccgugaucgacuacaagaagauccugggcaccaucaagaugaaggccauccugggcgacgugaaguacaagaccuucgccgacaacguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagguggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucgugacccugcuggugaucaucuacauccugcugcccaucugcuucaaggugagagacacccugagaaagcacgaggacgccuacaagagagagaugaagaucagauga

SEQ ID NO: 9387 - RNA, 4326 nt, Artificial Sequence
  derived and/or modified CDS sequence (opt4) from LACV(LACV/06/NY(2)-M (06MS350140))__GU206109.1__GP
augaucuacauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccuggcccugcugaucuucauccugcugagcauccugagcaagaccuacaucugcuaccugcugaugcccguguucauccccaucgccuacguguacggcgugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagguguucgagcuggaggagcugcccgacgacaugcuggagauggcccugagaaucaacuucuacuacuucaccugcauccugaacuacgccgugagcuggagccuggugaucaucggccugcugaccggccugcuguucaagagauaccagcacaaguuccugaacaucuacgccauguacugcgaggagugcgacauguaccacgacaagagcggccugaagagacacggcgacuucaccaacaagugcagacagugcaccugcggccaguacgaggacgccaccggccugaugacccacagaaagaccuacaacugccuggugcaguacaaggccaaguggaucaugaacuuccugaucaucuacaucuuccuggugcugaucaaggacagcgccaucaucgugcaggccgccggcaccgacuucagcagcugccuggagaccgagagcaucaacuggaacugcaccggccccuuccugaaccugggcaacugccagaagcagcagaagaaggagcccuacgccaacaucgccgcccagcugaagggccugaaggccaucagcgugcuggacauccccaugaucaccgagauccccgacgacaucgccagcgcccugagauacaucgaggagagagaggccuuccacgugcagcugaccgccgaguacgccaugcugaccagauacugcgacuacuacacccaguucagcgacaacagcggcuacagccagaccaccuggagaguguaccugagaagccacgacuucgaggccugcaucauguaccccaaccagcacuucugcagaugcgugaagaacggcgagaagugcagcagcagcaacugggacuucgccaacgagaugaaggacuacuacagcggcaagcaggccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagggccugcccggcauggccaacuucaagcacgacgaguucugggacgagcugcuguacaagcccacccccaccaaggcccccaaccuggccagaggcagagagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagccccugaacggcguguuccagagcagcaccgaccagagcauguacugccugcuggacagccacugccuggaggaguucgaggccaucagccaggaggagcuggacgccgugaagaagagcaagugcugggagaucgaguaccccgacaucaagccccugcaggagagcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccaaggagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccgugaucgacuacaagaagauccugggcaccaucaagaugaaggccauccugggcgacgugaaguacaagaccuucgccgacaacguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagguggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucgugacccugcuggugaucaucuacauccugcugcccaucugcuucaagcugagagacacccugagaaagcacgaggacgccuacaagagagagaugaagaucagauga

SEQ ID NO: 9388 - RNA, 4326 nt, Artificial Sequence
  derived and/or modified CDS sequence (opt4) from LACV(LACV/06/NY(3)-M (06MS270036))__GU206121.1__GP
augaucuacauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcauccaguuccacgccugcuucaaccagcacaugagcugcgugagauuccugcacagaaccauccugcccggcagcaucgccaacagcaucugccagaacaucgagaucaucauccuggugacccuggcccugcugaucuucauccugcugagcauccugagcaagaccuacaucugcuaccugcugaugcccguguucauccccaucgccuacguguacggcgugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagguguucgagcuggaggagcugcccgacgacaugcuggagauggcccugagaaucaacuucuacuacuucaccugcauccugaacuacgccgugagcuggagccuggugaucaucggccugcugaccggccugcuguucaagagauaccagcacaaguuccugaacaucuacgccauguacugcgaggagugcgacauguaccacgacaagagcggccugaagagacacggcgacuucaccaacaagugcagacagugcaccugcggccaguacgaggacgccaccggccugaugacccacagaaagaccuacaacugccuggugcaguacaaggccaaguggaucaugaacuuccugaucaucuacaucuuccuggugcugaucaaggacagcgccaucaucgugcaggccgccggcaccgacuucagcagcugccuggagaccgagagcaucaacuggaacugcaccggccccuuccugaaccugggcaacugccagaagcagcagaagaaggagcccuacgccaacaucgccgcccagcugaagggccugaaggccaucagcgugcuggacauccccaugaucaccgagauccccgacgacaucgccagcgcccugagauacaucgaggagagagaggccuuccacgugcagcugaccgccgaguacgccaugcugaccagauacugcgacuacuacacccaguucagcgacaacagcggcuacagccagaccaccuggagaguguaccugagaagccacgacuucgaggccugcaucauguaccccaaccagcacuucugcagaugcgugaagaacggcgagaagugcagcagcagcaacugggacuucgccaacggcaugaaggacuacuacagcggcaagcaggccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagggccugcccggcauggccaacuucaagcacgacgaguucugggacgagcugcuguacaagcccacccccaccaaggcccccaaccuggccagaggcagagagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagccccugaacggcguguuccagagcagcaccgaccagagcauguacugccugcuggacagccacugccuggaggaguucgaggccaucagccaggaggagcuggacgccgugaagaagagcaagugcugggagaucgaguacagcgacaucaagccccugcaggagagcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccaaggagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccgugaucgacuacaagaagauccugggcaccaucaagaugaaggccauccugggcgacgugaaguacaagaccuucgccgacaacguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagguggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucgugacccugcuggugaucaucuacauccugcugcccaucugcuucaagcugagagacacccugagaaagcacgaggacgccuacaagagagagaugaagaucagauga

SEQ ID NO: 9389 - RNA, 4326 nt, Artificial Sequence
  derived and/or modified CDS sequence (opt4) from LACV(LACV/65/OH-M (W17258))__GU206124.1__GP
augaucagaauccuggugcugaucgccgugaccgccgccaaccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccgugcugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggccagcagaaucgacagcuacuacuucaccugcauccugaacuacgccgugagcuggggccuggugaucaucggccugcugaccggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccaccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagaacaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuucuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugaagccccugcaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9390 - RNA, 4326 nt, Artificial Sequence
  derived and/or modified CDS sequence (opt4) from LACV(LACV/67/NY-M (67-8109))__GU206115.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaccaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacagagacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgaccagagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9391 - RNA, 4326 nt, Artificial Sequence
  derived and/or modified CDS sequence (opt4) from LACV(LACV/74/NY-M (74-32813))__GU206142.1__GP
augaucagaaugcuggugcugaucguggugaccgccgccagccccguguaccagagaugcuuccaggacggcgccaucgugaagcagaaccccagcaaggaggccgugaccgaggugugccugaaggacgacgugagcaugaucaagaccgaggccagauacgugaagaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacauguacggcgugaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggcccugagaaucaacagcuacuacuucaccugcauccugaacuacgccgugagcuggggccugaucaucgccggccugcuggugggccugaucuucaagaaguaccagcacagauuccugaacaucuacgccauguacugcgaggagugcaacauguaccacgacaagagcggccugaagagacacggcgacuucaccaacaagugcagacagugcaccugcggccaguacgaggacgccaccggccugaucacccacagaaagaccuacaacugccuggugcaguacaaggccaaguggaugaugaacuuccugaucaucuacaucuuccugauccugaucaaggacagcgccaucguggugcaggccaccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccagcauccccgacgacaucgccggcgcccugagauacaucgaggagaaggaggacuuccacgugcagcugaccaccgaguacgccaugcugagcaaguacugcgacuacuacacccaguucagcgacaacagcggcuacagccagaccaccuggagaguguaccugagaagccacgacuucgaggccugcauccuguaccccaaccagcacuucugcaagugcgugaagaacggcgagaagugcagcagcagcaacugggacuucgccaacgagaugaagaacuacuacagcggcaagcaggccaaguucgacaaggaccugaaccuggcccugaccgcccugcaccacgccuucagaggcaccagcagcgccuacaucgccgccaugcugagcaagaagagcaacgacgaccugaucgccuacaccaacaagaucaaggccaaguuccccggcaacgcccugcugaaggccaucaucgacuacaucgccuacaugaagggccugcccgagauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacagcagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugagaccccugcaggagagcgacggcgccaagagcugcagaaugaaggacagcggcaacugcaacguggccaccaacagauggcccgugaugcagugcgagaacgacaaguucuacuacagcgagcugcagaaggacuacgacaagacccaggacaucggccacuacugccugagccccggcugcaccaccaucagauaccccaucaaccccaagcacaucagcaacugcaacuggcaggugagcagaagcagcaucgccaagaucgacgugcacaacguggaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcgugggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccaacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcgccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccagaaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucaucgcccugcuggugaucaucuacgugcugcugcccaucugcuucaagcugagagacacccugagaaagcacgacgacgccuacaagagagagaugaagaucagauga

SEQ ID NO: 9392 - RNA, 4326 nt, Artificial Sequence
  derived and/or modified CDS sequence (opt4) from LACV(LACV/93/MO-H)__GU206139.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacaucuacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacuggggcuucgccaacgagaugaaggacuacuacagcggcaagcagaccaaguucgacaaggaccugaaccuggcccugaccgcccugcaccacgccuucagaggcaccagcagcgccuacauggccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgacaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggacggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagguggugugcaccgagaagcccggcaacacccugaccaucgaggugugcaacaccaagaucgaggccagcauggcccugguggacgccaagcccaucaucgagcuggcccccguggaccagaccaccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9393 - RNA, 4326 nt, Artificial Sequence
  derived and/or modified CDS sequence (opt4) from LACV(LACV/95/OH-H (CCH-MB96))__GU206136.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaugaucaccgccgugcuggugcugaccuucgugacccccaucaacagcauggugcugggcgagagcaaggagaccuucgagcuggaggagcugcccgacgacaugcuggagauggugagcagaaucaacagcuacuacuucaccugcauccugaacuacgccgugagcuggggccugaucaucaucggccugcugaccggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagagagaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacuggggcuucgccaacgagaugaaggacuucuacagcggcaagcagaccaaguucgacaaggaccugaaccuggcccugaccgcccugcaccacgccuucagaggcaccagcagcgccuacaucgccaccgugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccagcggccccagcguguacagaaagccccccggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugaagccccugcaggagagcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcagaggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9394 - RNA, 4326 nt, Artificial Sequence
  derived and/or modified CDS sequence (opt4) from LACV(LACV/95/WV-H)__GU206133.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaccaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgaccagagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9395 - RNA, 4326 nt, Artificial Sequence
  derived and/or modified CDS sequence (opt4) from LACV(LACV/96/WV-M (WV96-3955))__GU206145.1__GP
augaucuacauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagaagaucaccggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagguguucgagcuggaggagcugcccgacgacaugcuggagauggcccugagaaucaacagcuacuacuucaccugcauccugaacuacgccgugagcuggggccugaucaucaucggccugcugaccggccugcuguucaagaaguaccagcacagauuccugaacaucuacgccauguacugcgaggagugcgacauguaccacgacaagagcggccugaagagacacggcgacuucaccaacaagugcagacagugcaccugcggccaguacgaggacgccgccggccugaugacccacagaaagaccuacaacugccuggugcaguacaaggccaaguggaucaugaacuuccugaucguguacaucuuccugauccugaucaaggacagcgccaucaucgugagagccgccggcaccgacuucagcagcugccuggagaccgagaucaucaacuggaacugcaccggccccuuccugaaccugggcaacugccagagacagcagaagaaggagcccuacgccaacaucgccgcccagcugaagggccugaaggccaucagcgugcuggacauccccaugaucaccgagauccccgacgacaucgccagcgcccugagauacaucgaggagagagaggccuuccacgugcagcugaccgccgaguacgccaugcugagcagauacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcgccaacugggacuucgccaacgagaugaaggacuacuacagcggcaagcaggccaaguucgacaaggaccugaaccuggcccugaccgccaugcaccacgccuucagaggcaccagcagcgccuacauggccgccaugcugagcaagaagagcaacgacgaccugaucaccuacaccaacaagcugaagaccaaguuccccggcaacgcccugcugaaggccaucaucgacuacaucgccuacaugaagggccugcccggcauggccaacuucaagcacgacgaguucugggacgagcugcuguacaagcccacccccaccaaggcccccaaccuggccagaggcagagagagcagcuacaacuucgagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgaccagagcauguacugccugcuggacagccacugccuggaggaguucgaggccaucagccaggaggagcuggacgccgugaagaagagcaagugcugggagaucgaguaccccgacgugaagcugcugcaggagaacgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcgccaccaucagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcgugaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacaacguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagguggugugcaccgagaagcccggcaacacccugaccaucaaggugugcaacaccaagaucgaggccgccauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacauccugcugcccaucugcuucaagcugagagacacccugagaaagcacgaggacgccuacaagagagagaugaagaucagauga

SEQ ID NO: 9396 - RNA, 4326 nt, Artificial Sequence
  derived and/or modified CDS sequence (opt4) from LACV(LACV/97/NC-M (NC97-7306))__GU206127.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacaucagaaacgccaccggcguguucagcaacaacguggccaucagaaaguggcuggugagcgacuggcacgacugcagacccaagaagaucaucggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacguguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaugaucaccgccgugcuggugcugaccuucgugacccccaucaacagcauggugcugggcgagagcaaggagaccuucgagcuggaggagcugcccgacgacaugcuggagauggugagcagaaucaacagcuacuacuucaccugcauccugaacuacgccgugagcuggggccugaucaucaucggccugcugaccggccugcuguucaagaaguaccagcacagauuccugaacguguacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacauccccaucaucaccggcauccccgacgacaucgccggcgcccugagauacaucgaggagagagaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuucuacagcggcaagcagaccaaguucgacaaggaccugaaccuggcccugaccgcccugcaccacgccuucagaggcaccagcagcguguacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagccccccggcggcguguuccagagcagcaccgacagaagcaucuacugccugcuggacagccacugccuggaggaguucgaggccaucagccaggaggagcuggacgccgugaagaagagcaagugcugggagaucgaguaccccgacgugaagccccugcaggagagcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaaggccugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagagacccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9397 - RNA, 4326 nt, Artificial Sequence
  derived and/or modified CDS sequence (opt4) from LACV(LACV/human/1960)__EF485031.1__GP
augaucugcauccuggugcugaucaccguggccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucgugggcggccacaucaacgugaucgaggugggcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacaucuacggcaccaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggaccugcccgacgacaugcuggagauggccagcagaaucaacagcuacuaccugaccugcauccugaacuacgccgugagcuggggccuggugaucaucggccugcugaucggccugcuguucaagaaguaccagcacagauuccugaacguguacgccauguacugcgaggagugcgacauguaccacgacaagagcggccugaagggccacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucaacuggaacugcaccggccccuuccugaaccugggcaacugccagaagcagcagaagaaggagcccuacaccaacaucgccacccagcugaagggccugaaggccaucagcgugcuggacgugcccaucaucaccggcauccccgacgacaucgccggcgcccugagauacaucgaggagaaggaggacuuccacgugcagcugaccaucgaguacgccaugcugagcaaguacugcgacuacuacacccaguucagcgacaacagcggcuacagccagaccaccuggagaguguaccugagaagccacgacuucgaggccugcauccuguaccccaaccagcacuucugcagaugcgugaagaacggcgagaagugcagcagcagcaacugggacuucgccaacgagaugaaggacuacuacagcggcaagcagaccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcgacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgaccagagcaucuacugccugcuggacagccacugccuggaggaguucgaggccaucggccaggaggagcuggacgccgugaagaagagcaagugcugggagaucgaguaccccgacgugaagcugauccaggagggcgacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacaccaagcuguacagcaccggccccaccagcggcaucaacaccaagcacgacgagcugugcaccggccccugccccgccaacaucaaccaccaggugggcuggcugaccuucgccagagagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccaucuacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggugaucaucuacgugcugcugcccaucugcuucaagcugagagacacccugagaaagcacgaggacgccuacaagagagagaugaagaucagauga

SEQ ID NO: 9398 - RNA, 4326 nt, Artificial Sequence
  derived and/or modified CDS sequence (opt4) from LACV(LACV/mosquito/1978)__EF485037.1__GP
augaucagaauccuggugcugaucgccgugaccgccgccagccccguguaccagagaugcuuccaggacggcgccaucgugaagcagaaccccagcaaggaggccgugaccgaggugugccugaaggacgacgugagcaugaucaagaccgaggccagauacgugagaaacgccaccggcguguucagcaacaacguggccaucagaaaguggcuggugagcgacuggcacgacugcagacccaagaagaucaucggcggccacaucaacgugaucgaggugagcgacgaccugagccugcacaccgagagcuacgugugcagcgccgacugcaccaucggcguggacaaggagaccgcccaggugagacugcagaccgacaccaccaaccacuucgagaucgccggcaccaccgugaagagcggcugguucaagagcaccaccuacaucacccuggaccagaccugcgagcaccugaaggugagcugcggccccaagagcgugcaguuccacgccugcuucaaccagcacaugagcugcgugagauuccugcacagaaccauccugcccggcagcaucgccaacagcaucugccagaacaucgagaucaucauccuggugacccugacccugcugaucuucauccugcugagcauccugagcaagaccuacaucugcuaccugcugaugcccaucuucauccccaucgccuacauguacggcaucaucuacaacaagagcugcaagaagugcaagcugugcggccugguguaccaccccuucaccgagugcggcacccacugcgugugcggcgccagauacgacaccagcgacagaaugaagcugcacagagccagcggccugugccccggcuacaagagccugagagccgccagagugaugugcaagagcaagggccccgccagcauccugagcaucaucaccgccgugcuggugcugaccuucgugacccccaucaacagcauggugcugggcgagagcaaggagaccuucgagcuggaggagcugcccgacgacaugcuggagauggccagcagaaucaacagcuacuacuucaccugcauccugaacuacgccgugagcuggggccuggugaucaucggccugcugaccggccugcuguucaagaaguaccagcacagauuccugaacaucuacgccauguacugcgaggagugcgacauguaccacgacaagagcggccugaagagacacggcgacuucaccaacaagugcagacagugcaccugcggccaguacgaggacgccgccggccugauggcccacagaaagaccuacaacugccuggugcaguacaaggccaaguggaugaugaacuuccugaucaucuacaucuuccugauccugaucaaggacagcgccaucguggugcaggccgccggcaccgacuucaccaccugccuggagaccgagagcaucgacuggaacugcaccggccccuuccugaaccugggcaacugccagaagcagcagaagaaggagcccuacaccaacaucgccacccagcugaagggccugaaggccaucagcgugcuggacauccccaucaucaccagaauccccgacgacaucgccggcgcccugagauacaucgaggagagagaggacuuccacgugcagcugaccaccgaguacgccaugcugagcaaguacugcgacuacuacacccaguucagcgacaacagcggcuacagccagaccaccuggagaguguaccugagaagccacgacuucgaggccugcauccuguaccccaaccagaacuucugcagaugcgugaagaacggcgagaagugcagcagcagcaacugggacuucgccaacgagaugaaggacuacuaccccggcaagcaggccaaguucgacaaggaccugaaccuggcccugaccgcccugcaccacgccuucagaggcaccagcagcgccuacaucgccaccaugcugagcaagaagagcaacgacgaccugaucgccuacaccaacaagaucaagaccaaguuccccggcaacgcccugcugaaggccaucaucgacuacaucgccuacaugaagagccugcccggcauggccaacuucaaguacgacgaguucugggacgagcugcuguacaagcccaaccccgccaaggccagcaaccuggccagaggcaaggagagcagcuacaacuucaagcuggccaucagcagcaagagcaucaagaccugcaagaacgugaaggacguggccugccugagccccagaagcggcgccaucuacgccagcaucaucgccugcggcgagcccaacggccccagcguguacagaaagcccagcggcggcguguuccagagcagcaccgacagaagcaucuacugccugcuggacagccacugccuggaggaguucgaggccaucagccaggaggagcuggacgccgugaagaagagcaagugcugggagaucgaguacagcgacgugaagccccugcaggagggcaacggcaccaagagcugcagaaugaaggacagcggcaacugcaacguggccaccaacagauggcccgugauccagugcgagaacgacaaguucuacuacagcgagcugcagaaggacuacgacaagacccaggacaucggccacuacugccugagccccggcugcaccaccgugagauaccccaucaaccccaagcacaucagcaacugcaacuggcaggugagcagaagcagcaucgccaagaucgacgugcacaacaucgaggacaucgagcaguacaagaaggccaucacccagaagcugcagaccagccugagccuguucaaguacgccaagaccaagaaccugccccacaucaagcccaucuacaaguacaucaccaucgagggcaccgagaccgccgagggcaucgagagcgccuacaucgagagcgaggugcccgcccuggccggcaccagcaucggcuucaagaucaacagcaaggagggcaagcaccugcuggacgugaucgccuacgugaagagcgccagcuacagcagcguguacgccaagcuguacagcaccggccccaccagcggcaucaacaccaagcacgacgagcugugcaccggccccugccccgccaacaucaaccaccaggugggcuggcugaccuucgccaaggagagaaccagcagcuggggcugcgaggaguucggcugccuggccgugagcgacggcugcguguucggcagcugccaggacaucaucaaggaggagcugagcguguacagaaaggagaccgaggaggugaccgacguggagcugugccugaccuucagcgacaagaccuacugcaccaaccugaaccccgugacccccaucaucaccgaccuguucgaggugcaguucaagaccguggagaccuacagccugcccagaaucguggccgugcagaaccacgagaucaagaucggccagaucaacgaccugggcguguacagcaagggcugcggcaacgugcagaaggugaacggcaccguguacggcaacggcgugcccagauucgacuaccugugccaccuggccagcagaaaggaggugaucgugagaaagugcuucgacaacgacuaccaggccugcaaguuccugcagagccccgccagcuacagacuggaggaggacagcggcaccgugaccaucaucgacuacaagaagauccugggcaccaucaagaugaaggccauccugggcgacgugaaguacaagaccuucgccgacagcguggacaucaccgccgagggcagcugcaccggcugcaucaacugcuucgagaacauccacugcgagcugacccugcacaccaccaucgaggccagcugccccaucaagagcagcugcaccguguuccacgacagaauccuggugacccccaacgagcacaaguacgcccugaagauggugugcaccgagaagcccggcaacacccugaccaucaaggugugcaacaccaagaucgaggccagcauggcccugguggacgccaagcccaucaucgagcuggcccccguggaccagaccgccuacaucagagagaaggacgagagaugcaagaccuggaugugcagagugagagacgagggccugcaggugauccuggagcccuucaagaaccuguucggcagcuacaucggcaucuucuacaccuucaucaucagcaucguggcccugcuggccaucaucuacgugcugcugcccaucugcuucaagcugagagacacccugagaaagcacgaggacgccuacaagagagagaugaagaucagauga

SEQ ID NO: 9399 - RNA, 4326 nt, Artificial Sequence; identical to SEQ ID NO: 9368
  derived and/or modified CDS sequence (opt4) from LACV__KP271111.1__GP

SEQ ID NO: 9400 - RNA, 4263 nt, Artificial Sequence
  derived and/or modified CDS sequence (opt4) from OROV(BeAn19992)__NC_005775.1__GP
auggccaaccugaucaucaucagcauggugcugggcguggccuacggccacccccugagcaccagccagaucggcgacagaugcuucgccggcggcaaccuguucaaggagaugaaccugagcgugggccugggcgagaucugcgugaaggacgacaucagcaucgugaagagcaccaccguguucagcaagaacaagcccgcccuggaggccaccaccaaguucuacagaagcuucaucgugaaggacuggagcgagugcaaccccgugcuggacaaguucggcaacuucauggugcugagcguggacgacaacggccacaucauccccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacguggccuaccugcugcugccccuguucuaccccgugaccugguucuacggcaagguguacaagaagaucaacagcugccccaacugccugcuggccagccaccccuucaccagcugccccaaguucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgacgaguucaucaagcugaccgagcaggugaacauccuggagagagagauggaggugcugaagcagagcaucaucgugauguucgccaucauccuggugcugcugcuguucgagaacaugaucuucaacagacuguucagaaucuucuacagaagcugcagcaugugcggccugauccacuacagacccggccugaagaucgaccugaccaagaccaacagaugcggcagcugcaucugcggcuucgacgagcagcagagcagcggcuucgaguacgagaucuuccugaaggacaugcacgugcagaaggagagcugcaaguucagccccagagugaaccacuucagaaacaucaaggcccugcuguucgcccuggugaucugcgccaccaucuacaccguguacgccgacgaggacugccugagcaaggacaucaagaucaccuaccaggagcugcacaacugcaucggccccaagaucaugggcgacaccugcgugagcaagagcgagcuguacagcgaccuguucagcaagaaccuggugaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaacaacaccgacaucgacuacaacaaggagaucgagaccuacuacaagagcaacgccgccgccuacagagccgaccugaacaccaucauggacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaaccugaacaucaaggagugcaugagccccgagagccugaagugcuucaagaagagaggcagcaccccccacaccaaccaccugcugugcaagaucgacaacaaguacaaggccuucgacuggcccgagaucgagaccauccagaagggccagaagcugugccugggcgacagccacugcaaccuggaguucaccgccaucaccgccgacaagaucaugagccugaccaacugcuacaaggagagcuucaccgcccagcccgccgacaugcaggccggcaucaagaagugcagcgccgacgagaucggcgagugcaccacccuggaggacaagaccuggcccaucaucuucugcggcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagcaccaugagacagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugaacuuccagagcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacguguacaagaagaucggcagcgaggugagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacaucaacuacaagaucuucaccaagagcaucgaccugcagaugagcggcaucugcgccggcugcaucgacugcgccgagggcaucagcugcagcaucaacgccgaggugcccgccgagaccgugugccacugcaagaccaacugcgaggacuucaucaacaacaucguguucagcccccagaucaagaacuacaacaucaaggugcacugcaagagcaagguggagaagaucaccgcccacaucugcggcagagacaucgaccugcagcugaccaucaagcccuacaaccagaagaucgaccugagccagcuggacgagagcaacuacaucagagaggaggaccugcagugcggcaccuggcugugcaaggugcagaaggagggcaucgacaucaucuucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9401 - RNA, 4263 nt, Artificial Sequence
  derived and/or modified CDS sequence (opt4) from OROV(BeH759021)__KP691607.1__GP
auggccaaccugaucaucaucagcauggugcugagcguggccuacggccacccccugagcaccagccagaucggcgacagaugcuucgccggcggcaaccuguucaaggagaugaaccugagcgugggccugggcgagaucugcgugaaggacgacaucagcaucgugaagagcaccaccguguucagcaagaacagacccgcccuggaggccaccaccaaguucuacagaagcuucaucgugaaggacuggagcgagugcaaccccgugcuggacaaguucggcaacuucauggugcugagcguggacgacaacggccacaucaugcccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacguggccuaccugcugcugccccuguucuaccccgugaccugguucuacggcaagguguacaagaagaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgacgaguucaucaagcugaccgagcaggugaacauccuggagagagagauggaggugcugaagcagagcaucaucgugauguucgccaucauccuggugcugcugcuguucgagaacaugaucuucaacagacuguucagcaucuucuacagaagcugcagcaugugcggccugauccacuacagacccggccugaagaucgaccugaccaagaccaacaagugcggcagcugcaucugcggcuucaacgagcagcagagcagcggcuucgaguacgagaucuuccugaaggacaugcacauccagaaggagagcugcaaguucagccccagagugaaccacuucagaaacaucaaggcccugcuguucgcccuggugaucugcgccaccaucuacaccguguacgccgacgaggacugccugagcaaggacaucaagaucaccuaccaggagcugcacaacugcaucggccccaagaucaugggcaacaccugcgugagcaagaacgagcuguacagcgaccuguucagcaagaaccuggugaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuacaacaaggagaucgagaccuacuacaagagcaacgccgccgccuacagagccgaccugaacaccaucauggacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaacgugaacaucaaggagugcaugagccccgagagccugaagugcuucaagaagagagacagcaccccccacaccaaccaccugcugugcaagaucgacagcaaguacaaggccuucgacuggcccgagaucgagaccauccagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaccacccuggaggacaagaccuggcccaucguguucugcggcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagcaccaugagacagaucaacuacaacgacaucaccagcuacagaaaggccaucgagagcgagaucggcagcgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugaacuucaagggcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacguguacaagaagaucggcagcgaggugagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacgugaacuacaagaucuucaccaagagcaucgaccugcagaugagcggcaucugcgccggcugcaucgacugcgccgagggcaucagcugcagcaucaacgccgaggugcccgccgagaccgugugccacugcaagaccaacugcgaggacuucaucaacaacaucguguucagcccccagaucaagaacuacaacaucaaggugcacugcaagagcaagguggagaagaucaucgcccacaucugcggcagagacaucgaccugcagcugaccgugaagcccuacaaccagaagaucgaccugagccagcuggacgagagcaacuacaucagagaggaggaccugcagugcggcaccuggcugugcaaggugcagaaggagggcguggacaucaucuucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9402 - RNA, 4263 nt, Artificial Sequence
  derived and/or modified CDS sequence (opt4) from OROV(BeH759022)__KP691610.1__GP
auggccaaccugaucaucaucagcauggcccugagcguggccuacggccacccccugagcaccagccagaucggcgacagaugcuucgccggcggcaaccuguucaaggagaugaaccugagcgugggccugggcgagaucugcgugaaggacgacaucagcaucgugaagagcaccaccguguucagcaagaacagacccgcccuggaggccaccaccaaguucuacagaagcuucaucgugaaggacuggagcgagugcaaccccgugcuggacaaguucggcaacuucauggugcugagcguggacgacaacggccacaucaugcccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacguggccuaccugcugcugccccuguucuaccccgugaccugguucuacggcaagguguacaagaagaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgacgaguucaucaagcugaccgagcaggugaacauccuggagagagagauggaggugcugaagcagagcaucaucgugauguucgccaucauccuggugcugcugcuguucgagaacaugaucuucaacagacuguucagcaucuucuacagaagcugcagcaugugcggccugauccacuacagacccggccugaagaucgaccugaccaagaccaacaagugcggcagcugcaucugcggcuucaacgagcagcagagcagcggcuucgaguacgagaucuuccugaaggacaugcacauccagaaggagagcugcaaguucagccccagagugaaccacuucagaaacaucaaggcccugcuguucgcccuggugaucugcgccaccaucuacaccguguacgccgacgaggacugccugagcaaggacaucaagaucaccuaccaggagcugcacaacugcaucggccccaagaucaugggcaacaccugcgugagcaagaacgagcuguacagcgaccuguucagcaagaaccuggugaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuacaacaaggagaucgagaccuacuacaagagcaacgccgccgccuacagagccgaccugaacaccaucauggacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaacgugaacaucaaggagugcaugagccccgagagccugaagugcuucaagaagagagacagcaccccccacaccaaccaccugcugugcaagaucgacagcaaguacaaggccuucgacuggcccgagaucgagaccauccagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaccacccuggaggacaagaccuggcccaucguguucugcggcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagcaccaugagacagaucaacuacaacgacaucaccagcuacagaaaggccaucgagagcgagaucggcagcgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugaacuucaagggcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacguguacaagaagaucggcagcgaggugagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacgugaacuacaagaucuucaccaagagcaucgaccugcagaugagcggcaucugcgccggcugcaucgacugcgccgagggcaucagcugcagcaucaacgccgaggugcccgccgagaccgugugccacugcaagaccaacugcgaggacuucaucaacaacaucguguucagcccccagaucaagaacuacaacaucaaggugcacugcaagagcaagguggagaagaucaucgcccacaucugcggcagagacaucgaccugcagcugaccgugaagcccuacaaccagaagaucgaccugagccagcuggacgagagcaacuacaucagagaggaggaccugcagugcggcaccuggcugugcaaggugcagaaggagggcguggacaucaucuucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9403 - RNA, 4263 nt, Artificial Sequence
  derived and/or modified CDS sequence (opt4) from OROV(BeH759040)__KP691616.1__GP
auggccaaccugaucaucaucagcaugauccugagcguggccuacggccacccccugagcaccagccagaucggcgacagaugcuucgccggcggcaaccuguucaaggagaugaaccugagcgugggccugggcgagaucugcgugaaggacgacaucagcaucgugaagagcaccaccguguucagcaagaacagacccgcccuggaggccaccaccaaguucuacagaagcuucaucgugaaggacuggagcgagugcaaccccgugcuggacaaguucggcaacuucauggugcugagcguggacgacaacggccacaucaugcccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacguggccuaccugcugcugccccuguucuaccccgugaccugguucuacggcaagguguacaagaagaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgacgaguucaucaagcugaccgagcaggugaacauccuggagagagagauggaggugcugaagcagagcaucaucgugauguucgccaucauccuggugcugcugcuguucgagaacaugaucuucaacagacuguucagcaucuucuacagaagcugcagcaugugcggccugauccacuacagacccggccugaagaucgaccugaccaagaccaacaagugcggcagcugcaucugcggcuucaacgagcagcagagcagcggcuucgaguacgagaucuuccugaaggacaugcacauccagaaggagagcugcaaguucagccccagagugaaccacuucagaaacaucaaggcccugcuguucgcccuggugaucugcgccaccaucuacaccguguacgccgacgaggacugccugagcaaggacaucaagaucaccuaccaggagcugcacaacugcaucggccccaagaucaugggcaacaccugcgugagcaagaacgagcuguacagcgaccuguucagcaagaaccuggugaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuacaacaaggagaucgagaccuacuacaagagcaacgccgccgccuacagagccgaccugaacaccaucauggacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaacgugaacaucaaggagugcaugagccccgagagccugaagugcuucaagaagagagacagcaccccccacaccaaccaccugcugugcaagaucgacagcaaguacaaggccuucgacuggcccgagaucgagaccauccagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaccacccuggaggacaagaccuggcccaucguguucugcggcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagcaccaugagacagaucaacuacaacgacaucaccagcuacagaaaggccaucgagagcgagaucggcagcgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugaacuucaagggcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacguguacaagaagaucggcagcgaggugagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacgugaacuacaagaucuucaccaagagcaucgaccugcagaugagcggcaucugcgccggcugcaucgacugcgccgagggcaucagcugcagcaucaacgccgaggugcccgccgagaccgugugccacugcaagaccaacugcgaggacuucaucaacaacaucguguucagcccccagaucaagaacuacaacaucaaggugcacugcaagagcaagguggagaagaucaucgcccacaucugcggcagagacaucgaccugcagcugaccgugaagcccuacaaccagaagaucgaccugagccagcuggacgagagcaacuacaucagagaggaggaccugcagugcggcaccuggcugugcaaggugcagaaggagggcguggacaucaucuucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9404 - RNA, 4263 nt, Artificial Sequence
  derived and/or modified CDS sequence (opt4) from OROV(BeH759146)__KP691631.1__GP
auggccaaccugaucaucaucagcauggugcugagcguggccuacggccacccccugagcaccagccagaucggcgacagaugcuucgccggcggcaaccuguucaaggagaugaaccugagcgugggccugggcgagaucugcgugaaggacgacaucagcaucgugaagagcaccaccguguucagcaagaacagacccgcccuggaggccaccaccaaguucuacagaagcuucaucgugaaggacuggagcgagugcaaccccgugcuggacaaguucggcaacuucauggugcugagcguggacgacaacggccacaucaugcccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcugccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacguggccuaccugcugcugccccuguucuaccccgugaccugguucuacggcaagguguacaagaagaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgacgaguucaucaagcugaccgagcaggugaacauccuggagagagagauggaggugcugaagcagagcaucaucgugauguucgccaucauccuggugcugcugcuguucgagaacaugaucuucaacagacuguucagcaucuucuacagaagcugcagcaugugcggccugauccacuacagacccggccugaagaucgaccugaccaagaccaacaagugcggcagcugcaucugcggcuucaacgagcagcagagcagcggcuucgaguacgagaucuuccugaaggacaugcacauccagaaggagagcugcaaguucagccccagagugaaccacuucagaaacaucaaggcccugcuguucgcccuggugaucugcgccaccaucuacaccguguacgccgacgaggacugccugagcaaggacaucaagaucaccuaccaggagcugcacaacugcaucggccccaagaucaugggcaacaccugcgugagcaagaacgagcuguacagcgaccuguucagcaagaaccuggugaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuacaacaaggagaucgagaccuacuacaagagcaacgccgccgccuacagagccgaccugaacaucaucauggacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaacgugaacaucaaggagugcaugagccccgagagccugaagugcuucaagaagagagacagcaccccccacaccaaccaccugcugugcaagaucgacagcaaguacaaggccuucgacuggcccgagaucgagaccauccagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaccacccuggaggacaagaccuggcccaucguguucugcggcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagcaccaugagacagaucaacuacaacgacaucaccagcuacagaaaggccaucgagagcgagaucggcagcgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugaacuucaagggcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacgugugccuggccaucgacaccggcugccuguacggcagcugccaggacgugaucagacccgagcuggacguguacaagaagaucggcagcgaggugagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacgugaacuacaagaucuucaccaagagcaucgaccugcagaugagcggcaucugcgccggcugcaucgacugcgccgagggcaucagcugcagcaucaacgccgaggugcccgccgagaccgugugccacugcaagaccaacugcgaggacuucaucaacaacaucguguucagcccccagaucaagaacuacaacaucaaggugcacugcaagagcaagguggagaagaucaucgcccacaucugcggcagagacaucgaccugcagcugaccgugaagcccuacaaccagaagaucgaccugagccagcuggacgagagcaacuacaucagagaggaggaccugcagugcggcaccuggcugugcaaggugcagaaggagggcguggacaucaucuucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9405 - RNA, 4263 nt, Artificial Sequence
  derived and/or modified CDS sequence (opt4) from OROV(BeH759620)__KP691622.1__GP
auggccaaccugaucaucaucagcauggugcugagcguggccuacggccacccccugagcaccagccagaucggcgacagaugcuucgccggcggcaaccuguucaaggagaugaaccugagcgugggccugggcgagaucugcgugaaggacgacaucagcaucgugaagagcaccaccguguucagcaagaacagacccgcccuggaggccaccaccaaguucuacagaagcuucaucgugaaggacuggagcgagugcaaccccgugcuggacaaguucggcaacuucauggugcugagcguggacgacaacggccacaucaugcccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcaucaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacguggccuaccugcugcugccccuguucuaccccgugaccugguucuacggcaagguguacaagaagaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgacgaguucaucaagcugaccgagcaggugaacauccuggagagagagauggaggugcugaagcagagcaucaucgugauguucgccaucauccuggugcugcugcuguucgagaacaugaucuucaacagacuguucagcaucuucuacagaagcugcagcaugugcggccugauccacuacagacccggccugaagaucgaccugaccaagaccaacaagugcggcagcugcaucugcggcuucaacgagcagcagagcagcggcuucgaguacgagaucuuccugaaggacaugcacauccagaaggagagcugcaaguucagccccagagugaaccacuucagaaacaucaaggcccugcuguucgcccuggugaucugcgccaccaucuacaccguguacgccgacgaggacugccugagcaaggacaucaagaucaccuaccaggagcugcacaacugcaucggccccaagaucaugggcaacaccugcgugagcaagaacgagcuguacagcgaccuguucagcaagaaccuggugaccgaguacgacaagaaguacuucgagcccgacaccgugaacgaccaguucaacaagaucgaguucgcccaggacagccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuacaacaaggagaucgagaccuacuacaagagcaacgccgccgccuacagagccgaccugaacaccaucauggacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaacgugaacaucaaggagugcaugagccccgagagccugaagugcuucaagaagagagacagcaccccccacaccaaccaccugcugugcaagaucgacagcaaguacaaggccuucgacuggcccgagaucgagaccauccagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaccacccuggaggacaagaccuggcccaucguguucugcggcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagcaccaugagacagaucaacuacaacgacaucaccagcuacagaaaggccaucgagagcgagaucggcagcgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugaacuucaagggcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacguguacaagaagaucggcagcgaggugagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacgugaacuacaagaucuucaccaagagcaucgaccugcagaugagcggcaucugcgccggcugcaucgacugcgccgagggcaucagcugcagcaucaacgccgaggugcccgccgagaccgugugccacugcaagaccaacugcgaggacuucaucaacaacaucguguucagcccccagaucaagaacuacaacaucaaggugcacugcaagagcaagguggagaagaucaucgcccacaucugcggcagagacaucgaccugcagcugaccgugaagcccuacaaccagaagaucgaccugagccagcuggacgagagcaacuacaucagagaggaggaccugcagugcggcaccuggcugugcaaggugcagaaggagggcguggacaucaucuucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9406 - RNA, 4263 nt, Artificial Sequence
  derived and/or modified CDS sequence (opt4) from OROV(BeAn19991)__KP052851.1__GP
auggccaaccugaucaucaucagcauggugcugggcguggccuacggccacccccugagcaccagccagaucggcgacagaugcuucgccggcggcaaccuguucaaggagaugaaccugagcgugggccugggcgagaucugcgugaaggacgacaucagcaucgugaagagcaccaccguguucagcaagaacaagcccgcccuggaggccaccaccaaguucuacagaagcuucaucgugaaggacuggagcgagugcaaccccgugcuggacaaguucggcaacuucauggugcugagcguggacgacaacggccacaucauccccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacguggccuaccugcugcugccccuguucuaccccgugaccugguucuacggcaagguguacaagaagaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgacgaguucaucaagcugaccgagcaggugaacauccuggagagagagauggaggugcugaagcagagcaucaucgugauguucgccaucauccuggugcugcugcuguucgagaacaugaucuucaacagacuguucagaaucuucuacagaagcugcagcaugugcggccugauccacuacagacccggccugaagaucgaccugaccaagaccaacagaugcggcagcugcaucugcggcuucgacgagcagcagagcagcggcuucgaguacgagaucuuccugaaggacaugcacgugcagaaggagagcugcaaguucagccccagagugaaccacuucagaaacaucaaggcccugcuguucgcccuggugaucugcgccaccaucuacaccguguacgccgacgaggacugccugagcaaggacaucaagaucaccuaccaggagcugcacaacugcaucggccccaagaucaugggcgacaccugcgugagcaagagcgagcuguacagcgaccuguucagcaagaaccuggugaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuacuucaagaaccacaacaucgaccugugcagcagacacaacuacaagaugaucugccagugcaucaacacccacagcaugugcaagaacaccgacaucgacuacaacaaggagaucgagaccuacuacaagagcaacgccgccgccuacagagccgaccugaacaccaucauggacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaaccugaacaucaaggagugcaugagccccgagagccugaagugcuucaagaagagagacagcaccccccacaccaaccaccugcugugcaagaucgacaacaaguacaaggccuucgacuggcccgagaucgagaccauccagaagggccagaagcugugccugggcgacagccacugcaaccuggaguucaccgccaucaccgccgacaagaucaugagccugaccaacugcuacaaggagagcuucaccgcccagcccgccgacaugcaggccggcaucaagaagugcagcgccgacgagaucggcgagugcaccacccuggaggacaagaccuggcccaucaucuucugcggcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagcaccaugagacagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugaacuucaagggcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacguguacaagaagaucggcagcgaggugagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacaucaacuacaagaucuucaccaagagcaucgaccugcagaugagcggcaucugcgccggcugcaucgacugcgccgagggcaucagcugcagcaucaacgccgaggugcccgccgagaccgugugccacugcaagaccaacugcgaggacuucaucaacaacaucguguucagcccccagaucaagaacuacaacaucaaggugcacugcaagagcaagguggagaagaucaccgcccacaucugcggcagagacaucgaccugcagcugaccaucaagcccuacaaccagaagaucgaccugagccagcuggacgagagcaacuacaucagagaggaggaccugcagugcggcaccuggcugugcaaggugcagaaggagggcaucgacaucaucuucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9407 - RNA, 4263 nt, Artificial Sequence
  derived and/or modified CDS sequence (opt4) from OROV(Tr9760)__AF312381.2__GP
auggccaaccugaucaucaucagcauggugcugagcaucgccuacggccacccccugagcaccagccagaucggcgacagaugcuucgccggcggcaaccuguucaaggagaugaaccugagcgugggccugggcgagaucugcgugaaggacgacaucagcaucgugaagagcaccaccguguucagcaagaacaagcuggcccuggaggccaccaccaaguucuacagaagcuucaucgugaaggacuggagcgagugcaaccccgugcuggacaaguucggcaacuucauggugcugagcguggacgacaacggccacaccauccccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcgugagauucuucaagggcaccuacaugccccacagcaugaucgaggccaugugcgugaacaucgagcugaucauccugacccuguacaucuucgccgccaucaucuucgcccugaucaucaccaagagcuacguggccuaccugcugcugccccuguucuaccccgccaccugguucuacggcaagguguacaagaagaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgacgaguucaucaagcugaccgagcaggugaacauccuggagagagagauggaggugcugaagcagagcaucaucgugauguucgccaucauccuggugcugcugcuguucgagaacaugaucuucaacagacuguucagaaucuucuacagaagcugcagcaugugcggccugauccacuacagacccggccugaagaucgaccugaccaagaccaacagaugcggcagcugcaucugcggcuucgacgagcagcagagcagcggcuucgaguacgagaucuuccugaccgacaugcacgugcagaaggagagcugcaaguucagccccagagugaaccacuucagaaacaccaaggcccugcuguucgcccuggugaucugcgccaccaucuacaccguguacgccgacgaggacugccugagcaaggacaucaagaucaccuaccaggagcugcacaacugcaucggccccaagaucaugggcgacaccugcgugagcaagagcgagcuguacagcgaccuguucagcaagaaccuggugaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaacccaccugaagaaccacaacaucgaccugugcagcagacacaacuacaagaugaucugccagugcaucaacgcccacagcaugugcaagaacaccgacaucgacuacaacaaggagaucgagaccuacuacaagagcaacgccgccgccuacagagccggccugaacaccaucauggacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaacgugaacaucaaggagugcaugagccccgagagccugaagugcuucaagaagagagacagcaccccccacaccaaccaccugcugugcaagaucgacaacaaguacaaggccuucgacuggcccgagaucgagaccauccagaagggccagaagcugugccugggcgacagccacugcaaccuggaguucaccgccaucaccgccgacagaaucaugagccugaccaacugcuacaaggagagcuucaccgcccagcccgccgacaugcaggccggcaucaagaagugcagcgccgacgagaucggcgagugcaccacccuggaggacaagaccuggcccaucguguucugcagcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagacccuacgagaccaacaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccuggacgugggcuaccaccugaacuucaagggcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacguguacaagaagaucggcagcgaggccagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacaucaacuacaagaucuucaccaagagcguggaccugcagaugagcggcaucugcgccggcugcaucgacugcgccgagggcaucagcugcagcaucaacgccgaggugcccgccgagaccgugugccacugcaagaccaacugcgaggacuucaucaacaacaucguguucagcccccagaucaagaacuacaacaucaaggugcacugcaagagcaagguggagaagaucaccgcccacaucugcggcagagacaucgaccugcagcugaccgugaagcccuacaaccagaagaucgaccugagccagcuggacgagagcaacuacaucagagaggaggaccugcagugcggcaccuggcugugcaaggugcagaaggagggcaucgacaucauguucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9408 - RNA, 4263 nt, Artificial Sequence
  derived and/or modified CDS sequence (opt4) from OROV(TRVL-9760)__KC759123.1__GP
auggccaaccugaucaucaucagcauggugcugagcaucgccuacggccacccccugagcaccagccagaucggcgacagaugcuucgccggcggcaaccuguucaaggagaugaaccugagcgugggccugggcgagaucugcgugaaggacgacaucagcaucgugaagagcaccaccguguucagcaagaacaagcuggcccuggaggccaccaccaaguucuacagaagcuucaucgugaaggacuggagcgagugcaaccccgugcuggacaaguucggcaacuucauggugcugagcguggacgacaacggccacaucauccccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacguggccuaccugcugcugccccuguucuaccccgccaccugguucuacggcaagguguacaagaagaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgccgaguucaucaagcugaccgagcaggugaacauccuggagagagagauggaggugcugaagcagagcaucaucgugauguucgccaucauccuggugcugcugcuguucgagaacaugaucuucaacagacuguucagaaucuucuacagaagcugcagcaugugcggccugauccacuacagacccggccugaagaucgaccugaccaagaccaacagaugcggcagcugcaucugcggcuucgacgagcagcagagcagcggcuucgaguacgagaucuuccugaaggacaugcacgugcagaaggagagcugcaaguucagccccagagugaaccacuucagaaacaccaaggcccugcuguucgcccuggugaucugcgccaccaucuacaccguguacgccgacgaggacugccugagcaaggacaucaagaucaccuaccaggagcugcacaacugcaucggccccaagaucaugggcgacaccugcgugagcaagagcgagcuguacagcgaccuguucagcaagaaccuggugaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacgcccacagcaugugcaagaacaccgacaucgacuacaacaaggagaucgagaccuacuacaagagcaacgccgccgccuacagagccgaccugaacaccaucauggacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaacgugaacaucaaggagugcaugagccccgagagccugaagugcuucaagaagagagacagcaccccccacaccaaccaccugcugugcaagaucgacaacaaguacaaggccuucgacuggcccgagaucgagaccauccagaagggccagaagcugugccugggcgacagccacugcaaccuggaguucaccgccaucaccgccgacagaaucaugagccugaccaacugcuacaaggagagcuucaccgcccagcccgccgacaugcaggccggcaucaagaagugcagcgccgacgagaucggcgagugcaccacccuggaggacaagaccuggcccaucguguucugcagcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagcaccaugagacagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugaacuucaagggcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacguguacaagaagaucggcagcgaggccagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacaucaacuacaagaucuucaccaagagcguggaccugcagaugagcggcaucugcgccggcugcaucgacugcgccgagggcaucagcugcagcaucaacgccgaggugcccgccgagaccgugugccacugcaagaccaacugcgaggacuucaucaacaacaucguguucagcccccagaucaagaacuacaacaucaaggugcacugcaagagcaagguggagaagaucaccgcccacaucugcggcagagacaucgaccugcagcugaccgugaagcccuacaaccagaagaucgaccugagccagcuggacgagagcaacuacaucagagaggaggaccugcagugcggcaccuggcugugcaaggugcagaaggagggcaucgacaucauguucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9409 - RNA, 4263 nt, Artificial Sequence
  derived and/or modified CDS sequence (opt4) from OROV(TVP-19244/DEI-216)__KP795073.1__GP
auggccaaccugaucaucaucagcaugauccugggcaucgccuacggccacccccugagcaccagccagaucggcgacagaugcuucgccggcggcauccuguucaaggagaugaaccugagcgugggccugggcgagaucugcgugaaggacgacaucagcaucgugaagagcaccaccgccuucagcaagaacgcccuggcccuggaggccaccaccaaguucuacagaagcuucaucgugaaggacuggagcgagugcaaccccgugcuggacaaguucggcaacuucauggugcugaacguggacgacaacggccaccuggugcccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacaucgccuaccugcugcugccccuguucuaccccgugaccuggcuguacggcaagguguacaagagaaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucgugagccccaucgccggcgagagaauguacaagcuggaggagcuggccgacgacuacaucgagcugaccgagcaggugaacauccugggcaaggagaucaagauccugaagcagagcaucaucgugaugcuggccaucauccugauccugcugcugagcgagaacaucaucuucaacuaccuguucagcacccuguacagaagcugcagcaugugcggccugauccacuacagacccggccugaagguggacagcaccaagaccaacaagugcggcagcugcaucugcggcuucgacgagcagcagagcagcggcuucgaguacgagguguuccugaaggacaugcacgugcagagagagagcugcaaguucggccccagagugaaccacuucagaaacaccaagauccugcuguucaccguggccaucugcaccagcuucuacaccguguacgccgacgaggacugccugagcaagaacaucagaaucaccuaccaggagcugcacaacugcaucggcccccacaucaugggcgacaccugcaugagcaagagcgagcuguacagcgaccugcugagcaagaaccugaucaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuucaacaaggagaucgagaccuacuacaaggccaacgccgccgccuacagaagcgacuucaacaccaucaucgacacccugaagaccgccuucagaggccugaccaaggugcugaucgagaacuacaucgagaaggacgacagcgacgcccugaaggcccuguucagcaacaucaccgacagcgugcaggacaacuaccagauggugggcgugcugaaguucgccagcaagcugcugaacaucagccugggcagaaccaccagaagcgcccagcacagcaucaugaccaacgagauccccaagagcaaccccuucaccgacuacagcuacagcagcgugaacaucaaggagugcaugagccccgagagccugaagugcuucaagaagagagacagcgccccccacaugaaccaccugcugugcaagauggacaacaaguacaaggccuucgacuggcccgagaucgagaccgugcagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaucacccuggaggacaagagcuggcccaucguguucugcggcgacaaguacuacuacagcgacggcaaggagcacgccaaggacggcagcaucaacaacuacugccuggccaacaagugcagcgagcagagauuccccauccacaagaacugguucaagaagugcaacugggacaagacccacaaggaguucaccaccaugagacagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugggcuucaagggcaaccagcuguucgacaucgugaucuucgugaagaaggccguguacaaggcccaguaccagaagguguacaccaccggccccagcaucagcaucaacaucgagcacaacgagaagugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacaucuacaagaagaucggcagcgaggccagccugaucgagaucugcaucacccugccccacgagaccuacugcaacgacauggacauccuggagcccaucaucggcgacaagcugagcgccagcuuccagaacacccagaccaaccagcugcccaaccugauggccuacaagaagggcaagguguacaccggccagaucaacgacgugggcaacaccgcccugcagugcggcagcauccagguggugaacggcagcaccaucggcagcggcaaccccaaguucgacuacaucugccacgccaugagaagaaaggacgugaucgugagaaagugcuucaacgacaacuaccagagcugcaccagacugaaccccagaaacgaccugauccccuacagaaagggcgacaucaucgagaucagcaagaccggcagcaacaugggccagaugaccuucaagaucgagcugggcgacaucaacuacaagaucuucaccaagagcguggaccugcagaugagcggcaucugcgccggcugcaucgacugcgccgagggcaucagcugcagcaucaacgccgacgugagcgccgagaccgugugccacugcaagaccaacugcgaggacuucaucagcaacaucgugaucagcccccagaucaagaccuacaacaucaaggugcacugcaagagcaaggugaagaagaucaccgccaacaucugcggcagaaacaucgaccugcagcugaccgugaagcccuacaaccagaagaucgaccugagccagcuggacgagagcaacuacaucaaggaggaggaccugcagugcggcaccuggcugugcaaggugcagaaggagggcaucgacaucguguucaagggccuguucagcggccugggcaaguacugggccauccugaucuacagcaucaucggcaucaucguggugauccugcugaucuacgugcugcugcccaucggcagacugcugaaggccuuccugaucaagaacgagaucgaguacaccauggagcagaagaucaaguga

SEQ ID NO: 9410 - RNA, 4263 nt, Artificial Sequence
  derived and/or modified CDS sequence (opt4) from OROV(TVP-19249/GML-444672)__KP795076.1__GP
auggccaaccugaucaucuucagcaucauccugggcaucgccuacggccacccccugagcaccagccagaucggcgacagaugcuucgccggcggcagccuguucaaggagaugaaccugagcgugggccugggcgagaucugcgugaaggacgacaucagcaucgugaagagcaccaccgccuucagcaagaacacccuggcccuggaggccaccaccaaguucuacagaagcuucaucgugaaggacuggagcgagugcaaccccgugcuggacaagcugggcaacuucauggugcugaacguggacgacaacggccaccuggugcccagaauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcaucaacaucgagcugaucauccugacccuguacaucuucgccgccaucaucuucgcccugaucaucaccaagagcuacaucgccuaccugcugcugccccuguucuaccccgugaccuggcuguacggcaagguguacaagagaaucaacagcugcagcaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucgugagccccaucgccggcgagagaauguacaagcuggaggagcuggccgacgacuacaucgagauggccgagagagugggcaugcuggagaaggagaucaaggugcugaagcaguucaccaucgugaugcuggugaucauccugauccugcugcuguucgagaacaccaucuucaacuaccuguucaacacccuguacagaagcugcagcaugugcggccugauccacuacagacccggccugaagguggaccugaccaagaccaacaagugcggcagcugcaucugcggcuucgacgagcagcagagcagcggcuucgaguacgagguguuccugaaggacaugcacauccagagagagagcugcaaguucggccccagagugaaccacuucagaaacaccaagauccugcuguucaccaucgccaucugcaccagcuucuacaccguguacgccgacgaggacugccugagcaagaacaucaagaucaccuaccaggagcugcacaacugcaucggccccuacaucaugggcgacaccugcgugagcaagagcgagcuguacagcgaccugcugagcaagaaccugaucaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacaugcacagcaugugcaagaacaccgacaucgacuucaacaacgagaucgagaccuacuacaaggccaacgccgccgccuacagaagcgacuucuacaccaucaucgacacccugaagaccgccuucagaggccugaccaaggugcugaucgagaacuacaucgagaaggacgacagcgacgcccugaaggcccuguucagcaacaucaccaacagcgugcaggacaacuaccagauggugggcgugcugaaguucgccagcaagcugcugaacaucagccugggcagaagcaccagaagcgcccagcacagcaucaugaccaacgagauccccaagagcaaccccuucaccgacuacagcuacagcagcgugaacaucaaggagugcaugagccccgagagccugaagugcuucaagaagagagacagcgugccccacaccaaccaccugcugugcaagauggacaacaaguacaaggccuucgacuggcccgagaucgagaccgugcagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaucacccuggaggacaaggccuggcccaucguggugugcggcgacaaguacuacuacagcgacggcaaggagcacgccaaggacggcagcaucaacaacuacugccuggccaacaagugcagcgagcagagauuccccauccacaagaacugguucaagaagugcaacugggacaagacccacaaggaguucaccaccaugagacagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugggcuucagaggcaaccagcuguucgacaucgugaucuucgugaagaaggccguguacaaggcccaguaccagaagguguacaccaccggccccagcaucagcaucaacaucgagcacaacgagaagugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacaucuacaagaagaucggcagcgaggccagccugaucgagaucugcaucacccugccccacgagaccuacugcaacgacauggacauccuggagcccaucaucggcgacaagcugagcgccagcuuccagaacacccagaccaaccagcugcccgugcugauggccuacaagaagggcaagguguacaccggccagaucaacgacgugggcaacaccgcccugcagugcggcagcauccagguggugaacggcagcaccaucggcagcggcaaccccaaguucgacuacaucugccacgccaugagaagaaaggacgugaucgugagaaagugcuucaacgacaacuaccagagcugcaccagacuggacgccagaaacgaccugauccccuacagaaagggcgacaucaucgagaucagcaagaccggcagcaacaugggccagaugaccuucaagaucgagcugggcgacaucaacuacaagaucuucaccaagagcguggaccugcagaugagcggcaucugcgccggcugcaucgacugcgccgagggcaucagcugcagcaucaacgccgacgugagcgccgagaccgugugccacugcaagaccaacugcgaggacuucaucagcaacaucgugaucagcccccagaucaagaccuacaacaucaaggugcacugcaagagcaagguggagaagaucaccgccaacaucugcggcagaaacaucgaccugcagcugaccgugaagcccuacaaccagaagaucgaccugagccagcuggacgagagcaacuacaucaaggaggaggaccugcagugcggcaccuggcugugcaaggugcagaaggagggcaucgacaucguguucaagggccuguucagcggccugggcaaguacuggaccauccugaucuacagcaucaucggcaucaucgugaucgugcugcugaucuacgugcugcugcccaucggcagacugcugaaggccuuccugaucaagaacgagaucgaguacaccauggagcagaagaucaaguga

SEQ ID NO: 9411 - RNA, 4263 nt, Artificial Sequence
  derived and/or modified CDS sequence (opt4) from OROV(TVP-19254/GML-480914)__KP795082.1__GP
auggccaaccugaucaucaucagcauggugcugagcguggccuacggccacccccugagcaccagccagaucggcgacagaugcuucgccggcggcaaccuguucaaggagaugaaccugagcgugggccugggcgagaucugcgugaaggacgacaucagcaucgugaagagcaccaccgccuucagcaagaacaagcccgcccuggaggccaccaccaaguucuacagaagcuucaucgugaaggacuggagcgagugcaaccccgugcuggacaaguucggcaacuucauggugcugagcguggacgacaacggccacaucauccccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacguggccuaccugcugcugccccuguucuaccccgugaccugguucuacggcaagguguacaagaagaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucaucagccccaucgccggcgagagaauguacaagcuggaggagcuggccgacgaguucaucaagcugaccgagcaggugaacauccuggagagagagauggaggugcugaagcagagcgugaucgugaugcuggccaucauccuggugcugcugcuguucgagaacaugaucuucaacagacuguucagaaucuucuacagaagcugcagcaugugcggccugauccacuacagacccggccugaagaucgaccugaccaagaccaacagaugcggcagcugcaucugcggcuucgacgagcagcagagcagcggcuucgaguacgagaucuuccugaaggacaugcacauccagaaggagagcugcaaguucagccccagagugaaccacuucagaaacaucaaggcccugcuguucgcccuggugaucugcgccaccaucuacaccguguacgccgacgaggacugccugagcaagaacaucaagaucaccuaccaggagcugcacaacugcaucggccccaagaucaugggcgacaccugcgugagcaagagcgagcuguacagcgaccuguucagcaagaaccuggugaccgaguacgacaagaaguacuucgagcccgacaccaucaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuacaacaaggagaucgagaccuacuacaagagcaacgccgccgccuacagagccgaccugaacaccaucaucgacacccugaagaccgccuucagaggccugaccaaggugcugaucgagaacuacaucgagaaggacgacagcgacgcccugaaggcccuguucagcaacaucaccgacagcgugcaggacaacuaccagaugaucggcauccugaaguucgccagcaagcugcuggacaucaaccugggcagaagcaccagaagcgcccaccacagcaucaugaccaacgagauccccaagagcaaccccuucaccgacuacagcuacagcaacgugaacaucaaggagugcaugagccccgagagccugaagugcuucaagaagagagacagcaccccccacaccaaccaccugcugugcaagaucgacaacaaguacaaggccuucgacuggcccgagaucgagaccauccagaagggccagaagcugugccugggcgacagccacugcaaccuggaguucaccgccaucaccgccgacaagaucaugagccugaccaacugcuacaaggagagcuucaccgcccagcccgccgacaugcaggccggcaucaagaagugcagcgccgacgagaucggcgagugcaccacccuggaggacaagaccuggcccaucguguucugcggcggcaaguacuacuacagcgacagcaaggagcacgccaaggacggcagcaucaacaacuacugccugaccaacaagugcagcgagcagagauuccccauccacgagaacugguucaagaagugcaacugggacaagacccacaaggaguucagcaccaugaagcagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggccugaucaacggcuucauccagaacaccauccccgccaucagcggccugggcgugggcuaccaccugaacuucaagggcaaccagcuguucgacaucgugaucuucgugaagaaggccguguacaaggcccaguaccagaaggccuacaccaccggccccagcaucagcaucaacaucgagcacaacgagagaugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacguguacaagaagaucggcagcgaggugagccugaucgagaucugcaucacccugccccacgagaccuacugcaacgacauggacauccuggagcccaucaucggcgacaagcugagcgccagcuuccagaacacccagaccaaccagcugcccacccugaucgccuacaagaagggcaagaucuacaccggccagaucaacgacaucggcaacaccgcccugcagugcggcagcauccaggugaucaacggcagcaccaucggcaccggcagccccaaguucgacuacaucugccacgccaugagaagaaaggacgugaucgugagaaagugcuucaacgacaacuaccagagcugcaccagacuggagaagagaaacgaccugauccccuacagaaagggcgacgugaucgaggugagcaagaccggcagcaacaugggccagaugaccuucaagaucgagcugggcgacaucaacuacaagaucuucaccaagagcaucgaccugcagaugagcggcaucugcgccggcugcaucgacugcgccgagggcaucagcugcagcaucaacgccgaggugagcgccgagaccgugugccacugcaagaccaacugcgaggacuucaucaacaacaucguguucagcccccagaucaagaacuacaacaucaaggugcacugcaagagcaagguggagaagaucaucgcccacaucugcggcaaggacaucgaccugcagcugaccgugaagcccuacaaccagaagaucgaccugagccagcuggacgagagcaacuacaucagagaggaggaccugcagugcggcaccuggcugugcaaggugcagaaggagggcaucgacaucaucuucaagggccuguucagcggccugggcagauacuggaccauccugaucuacagcaucaucggcguggugaucaucgugauccugguguacauccugcugcccaucggcagacugcugaaggccuuccugaucagacacgagaucgaguacgccauggagcagaagaucaaguga

SEQ ID NO: 9412 - RNA, 4263 nt, Artificial Sequence
  derived and/or modified CDS sequence (opt4) from OROV(TVP-19256/IQE-7894)__KP795085.1__GP
auggccaaccugaucaucaucagcaugauccugggcaucgccuacggccacccccugagcaccagccagaucggcgacagaugcuucgccggcggcagccuguucaaggagaugaaccugagcgugggccugggcgagaucugcgugaaggacgacaucagcaucgugaagagcaccaccgccuucagcaagaacgcccuggcccuggaggccaccaccaaguucuacagaagcuucaucgugaaggacuggagcgagugcaaccccgugcuggacaaguucggcaacuucauggugcugaacguggacgacaacggccaccuggugcccaagauguacaccugcagagccgccugcgacaucagacugaacaaggacaacgccgaggugauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcgccuacaugcccuacagcaugaucgaggccaugugcgugaacaucgagcugaucauccugacccuguacaucuucgccgccaucaucuucgcccugaucaucaccaagagcuacaucgccuaccugcugcugccccuguucuaccccgugaccuggcuguacggcaagguguacaagagaaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucgugagccccaucgccggcgagagaauguacaagcuggaggagcuggccgacgacuacaucgagcuggccgagcaggugaacauccugggcaaggagaucaagauccugaagcagagcaucaucgugaugcuggccaucauccugauccugcugcugagcgagaacaucaucuucaacuaccuguucaagacccuguacagaagcugcagcaugugcggccugauccacuacagacccggccugaagguggaccugaccaagaccaacaagugcggcagcugcaucugcggcuucgacgagcagcagagcagcggcuucgaguacgagguguuccugaaggacaugcacgugcagagagagagcugcaaguucggccccagagugaaccacuucagaaacaccaagauccugcuguucaccaucgccaucugcaccagcuucuacaccguguacgccgacgaggacugccugagcaagaacaucagaaucaccuaccaggagcugcacaacugcaucggcccccacaucaugggcgacaccugcaugagcaagagcgagcuguacagcgaccugcugagcaagaaccugaucaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuucaacaaggagaucgagaccuacuacaaggccaacgccgccgccuacagaagcgacuucaacaccaucaucgacacccugaagaccgccuucagaggccugaccaaggugcugaucgagaacuacaucgagaaggacgacagcgacgcccugaaggcccuguucagcaacaucaccgacagcgugcaggacaacuaccagauggugggcgugcugaaguucgccagcaagcugcugaacaucagccugggcagaaccaccagaagcgcccagcacagcaucaugaccaacgagauccccaagagcaaccccuucaccgacuacagcuacagcagcgugaacaucaaggagugcaugagccccgagagccugaagugcuucaagaagagagacagcgugccccacaccaaccaccugcugugcaagauggacaacaaguacaagguguucgacuggcccgagaucgagaccgugcagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaucacccuggaggacaagagcuggcccaucguguucugcggcgacaaguacuacuacagcgagggcaaggagcacgccaaggacggcagcaucaacaacuacugccuggccaacaagugcagcgagcagagauuccccauccacaagaacuggcugaagaagugcaacugggacaagacccacaaggaguucaccaccaugagaagaaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugggcuucaagggcaaccagcuguucgacaucgugaucuucgugaagaaggccguguacaaggcccaguaccagaagguguacaccaccggccccagcaucagcaucaacaucgagcacaacgagaagugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacaucuacaagaagaucggcagcgaggccagccugaucgagaucugcaucacccugccccacgagaccuacugcaacgacauggacauccuggagcccaucaucggcgacaagcugagcgccagcuuccagaacacccagaccaaccagcugcccaaccugauggccuacaagaagggcaagguguacaccggccagaucaacgacgugggcaacaccgcccugcagugcggcagcauccagguggugaacggcagcaccaucggcagcggcaaccccaaguucgacuacaucugccacgccaugagaagaaaggacgugaucgugagaaagugcuucaacgacaacuaccagagcugcaccagacuggaccccagaaacgaccugauccccuacagaaagggcgacaucguggagaucagcaagaccggcagcaacaugggccagaugaccuucaagaucgagcugggcgacaucaacuacaagaucuucaccaagagcguggaccugcagaugagcggcaucugcgccggcugcaucgacugcgccgagggcaucagcugcagcaucaacgccgacgccagcgccgagaccgugugccacugcaagaccaacugcgaggacuucaucagcaacaucgugaucagcccccagaucaagaccuacaacaucaaggugcacugcaagagcaagguggagaagaucaccgccaacaucugcggcagaaacaucgaccugcagcugaccgugaagcccuacaaccagaagaucgaccugagccagcuggacgagagcaacuacaucaaggaggaggaccugcagugcggcaccuggcugugcaaggugcagaaggagggcaucgacaucguguucaagggccuguucagcggccugggcaaguacugggccauccugaucuacagcaucaucggcgugaucguggugauccugcugaucuacgugcugcugcccaucggcagacugcugaaggccuuccugaucaagaacgagaucgaguacaccauggagcagaagaucaaguga

SEQ ID NO: 9413 - RNA, 4263 nt, Artificial Sequence
  derived and/or modified CDS sequence (opt4) from OROV(TVP-19257/IQT-1690)__KP795088.1__GP
auggccaaccugaucaucauccccaugauccugggcaucgccuacggccacccccugagcaccagccagaucggcgacagaugcuucgccggcggcagccuguucaaggagaugaaccugagcgugggccugggcgagaucugcgugaaggacgacaucagcaucgugaagagcaccaccgccuucagcaagaacgcccuggcccuggaggccaccaccaaguucuacagaagcuucaucgugaaggacuggagcgagugcaaccccgugcuggacaaguucggcaacuucauggugcugaacguggacgacaacggccaccuggugcccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagagaagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacaucgccuaccugcugcugccccuguucuaccccgugaccuggcuguacggcaagguguacaagagaaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucgugagccccaucgccggcgagagaauguacaagcuggaggagcuggccgacgacuacaucgagcuggccgagcaggugaacauccugggcaaggagaucaagauccugaagcagagcaucaucgugaugcuggccaucauccugauccugcugcugagcgagaacaucaucuucaacuaccuguucaacacccuguacagaagcugcagcaugugcggccugauccacuacagacccggccugaagguggaccugaccaagaccaacaagugcggcagcugcaucugcggcuucgacgagcagcagagcagcggcuucgaguacgagguguuccugaaggacaugcacgugcagagagagagcugcaaguucggccccagagugaaccacuucagaaacaccaagauccugcuguucaucaucgccaucugcaccagcuucuacaccguguacgccgacgaggacugccugagcaagaacaucagaaucaccuaccaggagcugcacaacugcaucggcccccacaucaugggcgacaccugcaugagcaagagcgagcuguacagcgaccugcugagcaagaaccugaucaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuucaacaaggagaucgagaccuacuacaaggccaacgccgccgccuacagaagcgacuucaacaccaucaucgacacccugaagaccgccuucagaggccugaccaaggugcugaucgagaacuacaucgagaaggacgacagcgacgcccugaaggcccuguucagcaacaucaccgacagcgugcaggacaacuaccagauggugggcgugcugaaguucgccagcaagcugcugaacaucagccugggcagaaccaccagaagcgcccagcacagcaucaugaccaacgagauccccaagagcaaccccuucaccgacuacagcuacagcagcgugaacaucaaggagugcaugagccccgagagccugaagugcuucaagaagagagacagcgccccccacaccaaccaccugcugugcaagauggacaacaaguacaaggccuucgacuggcccgagaucgagaccgugcagaagggccagaagcugugccugggcgacagccacugcaaccuggaguucaccgccaucaccgccgacaagaucaugagccugaccaacugcuacaaggagagcuucaccgcccagcccgccgacaugcagaccggcgugaagaagugcagcgccgacgagaucggcgagugcaucacccuggaggacaagagcuggcccaucguguucugcggcgacaaguacuacuacagcgacggcaaggagcacgccaaggacggcagcaucaacaacuacugccuggccaacaagugcagcgagcagagauuccccauccacaagaacugguucaagaagugcaacugggacaagacccacaaggaguucaccaccaugagacagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugggcuucaagggcaaccagcuguucgacaucgugaucuucgugaagaaggccguguacaaggcccaguaccagaagguguacaccaccggccccagcaucagcaucaacaucgagcacaacgagaagugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacaucuacaagaagaucggcagcgaggccagccugcuggagaucugcaucacccugccccacgagaccuacugcaacgacauggacauccuggagcccaucaucggcgacaagcugagcgccagcuuccagaacacccagaccaaccagcugcccaaccugauggccuacaagaagggcaagguguacaccggccagaucaacgacgugggcaacaccgcccugcagugcggcagcauccagguggugaacggcagcaccaucggcagcggcaaccccaaguucgacuacaucugccacgccaugagaagaaaggacgugaucgugagaaagugcuucaacgacaacuaccagagcugcaccagacuggaccccagaaacgaccugauccccuacagaaagggcgacaucaucgagaucagcaagaccggcagcaacaugggccagaugaccuucaagaucgagcugggcgacaucaacuacaagaucuucaccaagagcguggaccugcagaugagcggcaucugcgccggcugcaucgacugcgccgagggcaucagcugcagcaucaacgccgacgugagcgccgagaccgugugccacugcaagaccaacugcgaggacuucaucagcaacaucgugaucagcccccagaucaagaccuacaacaucaaggugcacugcaagagcaagguggagaagaucaccgccaacaucugcggcagaaacaucgaccugcagcugaccgugaagcccuacaaccagaagaucgaccugagccagcuggacgagagcaacuacaucaaggaggaggaccugcagugcggcaccuggcugugcaaggugcagaaggagggcaucgacaucguguucaagggccuguucagcggccugggcaaguacugggccauccugaucuacagcaucaucggcaucaucguggugauccugcugaucuacgugcugcugcccaucggcagacugcugaaggccuuccugaucaagaacgagaucgaguacaccauggagcagaagaucaaguga

SEQ ID NO: 9414 - RNA, 4263 nt, Artificial Sequence
  derived and/or modified CDS sequence (opt4) from OROV(TVP-19258/IQT-4083)__KP795091.1__GP
auggccaaccugaucaucaucagcaugauccugggcaucgccuacggccacccccugagcaccagccagaucggcgacagaugcuucgccggcggcagccuguucaaggagaugaaccugagcgugggccugggcgagaucugcgugaaggacgacaucagcaucgugaagagcaccaccgccuucagcaagaacgcccuggcccuggaggccaccaccaaguucuacagaagcuucaucgugaaggacuggagcgagugcaaccccgugcuggacaaguucggcaacuucauggugcugaacguggacaacaacggccaccuggugcccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagagccugcaucagauucuucaagggcaccuacaugcccuacagcaugaucgaggccaugugcgugaacaucgagcugaucauccugacccuguacaucuucgccgccaucaucuucgcccugaucaucaccaagagcuacaucgccuaccugcugcugccccuguucuaccccgccaccuggcuguacggcaagguguacaagagaaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucgugagccccaucgccggcgagagaauguacaagcuggaggagcuggccgacgacuacaucgagcugaccgagcaggugaacauccugggcaaggagaucaagauccugaagcagagcaucaucgugaugcuggccaucauccugauccugcugcugagcgagaacaucaucuucaacuaccuguucaacacccuguacagaagcugcagcaugugcggccugauccacuacagacccggccugaagguggaccugaccaagaccaacaagugcggcagcugcaucugcggcuucgacgagcagcagagcagcggcuucgaguacgagguguuccugaaggacaugcacgugcagagagagagcugcaaguucggccccagagugaaccacuucagaaacaccaagauccugcuguucaccaucgccaucugcaccagcuucuacaccguguacgccgacgaggacugccugagcaagaacaucagaaucaccuaccaggagcugcacaacugcaucggcccccacaucaugggcgacaccugcaugcccaagagcgagcuguacagcgaccugcugagcaagaaccugaucaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuucaacaaggagaucgagaccuacuacaaggccaacgccgccgccuacagaagcgacuucaacaccaucaucgacacccugaagaccgccuucagaggccugaccaaggugcugaucgagaacuacaucgagaaggacgacagcgacgcccugaaggcccuguucagcaacaucaccgacagcgugcaggacaacuaccagauggugggcgugcugaaguucgccagcaagcugcugaacaucagccugggcagaaccaccagaagcgcccagcacagcaucaugaccaacgagauccccaagagcaaccccuucaccgacuacagcuacagcagcaucaacaucaaggagugcaugagccccgagagccugaagugcuucaagaagagagacagcgccccccacaccaaccaccugcugugcaagaucgacaacaaguacaaggccuucgacuggcccgagaucgagaccgugcagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaucacccuggaggacaagagcuggcccaucaucuucugcggcgacaaguacuacuacagcgacggcaaggagcacgccaaggacggcagcaucaacaacuacugccuggccaacaagugcagcgagcagagauuccccauccacaagaacugguucaagaagugcaacugggacaagacccacaaggaguucaccaccaugagacagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugggcuucaagggcaaccagcuguucgacaucgugaucuucgugaagaaggccguguacaaggcccaguaccagaagguguacaccaccggccccagcaucagcaucaacaucgagcacaacgagaagugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacaucuacaagaagaucggcagcgaggccagccugaucgagaucugcaucacccugccccacgagaccuacugcaacgacauggacauccuggagcccaucaucggcgacaagcugagcgccagcuuccagaacacccagaccaaccagcugcccaaccugauggccuacaagaagggcaagguguacaccggccagaucaacgacgugggcaacaccgcccugcagugcggcagcauccagguggugaacggcagcaccaucggcagcggcaaccccaaguucgacuacaucugccacgccaugagaagaaaggacgugaucgugagaaagugcuucaacgacaacuaccagagcugcaccagacuggaccccagaaacgaccugauccccuacagaaagggcgacaucaucgagaucagcaagaccggcagcaacaugggccagaugaccuucaagaucgagcugggcgacaucaacuacaagaucuucaccaagagcguggaccugcagaugagcggcaucugcgccggcugcaucgacugcgccgagggcaucagcugcagcaucaacgccgacgugagcgccgagaccgugugccacugcaagaccaacugcgaggacuucaucagcaacaucgugaucagcccccagaucaagaccuacaacaucaaggugcacugcaagagcaagguggagaagaucaccgccaacaucugcgagagaaacaucgaccugcagcugaccgugaagcccuacaaccagaagaucgaccugagccagcuggacgagagcaacuacaucaaggaggaggaccugcagugcggcaccuggcugugcaaggugcagaaggagggcaucgacaucguguucaagggccuguucagcggccugggcaaguacugggccauccugaucuacagcaucaucggcaucaucguggugauccugcugaucuacgugcugcugcccaucggcagacugcugagagccuuccugaucaagaacgagaucgaguacaccauggagcagaagaucaaguga

SEQ ID NO: 9415 - RNA, 4263 nt, Artificial Sequence
  derived and/or modified CDS sequence (opt4) from OROV(TVP-19259/IQT-7085)__KP795094.1__GP
auggccaaccugaucaucaucagcaugauccugggcaucgccuacggccacccccugagcaucagccagaucggcgacagaugcuucgccggcggcagccuguucaaggagaugaaccugagcgugggccugggcgagaucugcgugaaggacgacaucagcaucgugaagagcaccaccgccuucagcaagaacgcccuggcccuggaggccaccaccaaguucuacagaagcuucaucgugaaggacuggagcgagugcaaccccgugcuggacaaguucggcaacuucauggugcugaacguggacgacaacggccaccuggugcccaagauguacaccugcagagccgccugcgacaucagacugaacaaggacaacgccgagaucauccugagcagcaccaagcugaaccacuucgagaucgugggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacaucgccuaccugcugcugccccuguucuaccccgugaccuggcuguacggcaagguguacaagagaaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucgugagccccaucgccggcgagagaauguacaagcuggaggagcuggccgacgacuacaucgagcuggccgagcaggugaacauccugggcaaggagaucaagauccugaagcagagcaucguggugaugcuggccaucauccugauccugcugcugagcgagaacaucaucuucaacuaccuguucaacacccuguacagaagcugcagcaugugcggccugauccacuacagacccggccugaagguggaccugaccaagaccaacaagugcggcagcugcaucugcggcuucgacgagcagcagagcagcggcuucgaguacgagguguuccugaaggacaugcacgugcagagagagagcugcaaguucggccccagagugaaccacuucagaaacaccaagauccugcuguucaccaucgccaucugcaccagcuucuacaccguguacgccgacgaggacugccugagcaagaacaucagaaucaccuaccaggagcugcacaacugcaucggcccccacaucaugggcgacaccugcaugagcaagagcgagcuguacagcgaccugcugagcaagaaccugaucaccgaguacgacaagaaguacuucgagcccgacaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuucaacaaggagaucgagaccuacuacaaggccaacgccgccgccuacagaagcgacuucaacaccaucaucgacacccugaagaccgccuucagaggccugaccaaggugcugaucgagaacuacaucgagaaggacgacagcgacgcccugaaggcccuguucagcaacaucaccgacagcgugcaggacaacuaccagauggugggcgugcugaaguucgccagcaagcugcugaacaucagccugggcagaaccaccagaagcgcccagcacagcaucaugaccaacgagauccccaagagcaaccccuucaccgacuacagcuacagcagcgugaacaucaaggagugcaugagccccgagagccugaagugcuucaagaagagagacagcgccccccacaccaaccaccugcugugcaagauggacaacaaguacaaggccuucgacuggcccgagaucgagaccgugcagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaucacccuggaggacaagagcuggcccaucguguucugcggcgacaaguacuacuacagcgacggcaaggagcacgccaaggacggcagcaucaacaacuacugccuggccaacaagugcagcgagcagagauuccccauccacaagaacugguucaagaagugcaacugggacaagacccacaaggaguucaccaccaugagacagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugggcuucaagggcaaccagcuguucgacaucgugaucuucgugaagaaggccguguacaaggcccaguaccagaagguguacaccaccggccccagcaucagcaucaacaucgagcacaacgagaagugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacaucuacaagaagaucggcagcgaggccagccugaucgagaucugcaucacccugccccacgagaccuacugcaacgacauggacauccuggagcccaucaucggcgacaagcugagcgccagcuuccagaacacccagaccaaccagcugcccaaccugauggccuacaagaagggcaagguguacaccggccagaucaacgacgugggcaacaccgcccugcagugcggcagcauccagguggugaacggcagcaccaucggcagcggcaaccccaaguucgacuacaucugccacgccaugagaagaaaggacgugaucgugagaaagugcuucaacgacaacuaccagagcugcaccagacuggaccccagaaacgaccugauccccuacagaaagggcgacaucaucgagaucagcaagaccggcagcaacaugggccagaugaccuucaagaucgagcugggcgacaucaacuacaagaucuucaccaagagcguggaccugcagaugagcggcaucugcgccggcugcaucgacugcgccgagggcaucagcugcagcaucaacgccgacgugagcgccgagaccgugugccacugcaagaccaacugcgaggacuucaucagcaacaucgugaucagcccccagaucaagaccuacaacaucaaggugcacugcaagagcaagguggagaagaucaccgccaacaucugcggcagaaacaucgaccugcagcugaccgugaagcccuacaaccagaagaucgaccugagccagcuggacgagagcaacuacaucaaggaggaggaccugcagugcggcaccuggcugugcaaggugcagaaggagggcaucgacaucguguucaagggccuguucagcggccugggcaaguacugggccauccugaucuacagcaucaucggcgugaucguggugauccugcugaucuacgugcugcugcccaucggcagacugcugaaggccuuccugaucaagaacgagaucgaguacaccauggagcagaagaucaaguga

SEQ ID NO: 9416 - RNA, 4263 nt, Artificial Sequence
  derived and/or modified CDS sequence (opt4) from OROV(TVP-19262/OBS-9478)__KP795100.1__GP
auggccaaccugaucaucaucagcaugauccugggcaucgccuacggccacccccugagcaccagccagaucggcgacagaugcuucgccggcggcagccuguucaaggagaugaaccugagcgugggccugggcgagaucugcgugaaggacgacaucagcaucgugaagagcaccaccgccuucagcaagaacgcccuggcccuggaggccaccaccaaguucuacagaagcuucaucgugaaggacuggagcgagugcaaccccgugcuggacaaguucggcaacuucauggugcugaacguggacaacaacggccaccugauccccaagauguacaccugcagagccgccugcgacaucagacugaacaaggacaacgccgagaucauccugagcagcaccaagcugaaccacuucgagaucaucggcaccaccagcaccagcggcugguucaagaacaccaucaccaacaaccuggagcacaccugcgagcacgugaccgugaacugcggccagaagagcgugaaguuccacgccugcuucagacagcacagaggcugcaucagauucuucaagggcaccuacaugcccuacagcaugaucgaggccaugugcgugaacaucgagcugaucauccugacccuguacaucuucgccgccaucaucuucgcccugaucaucaccaagagcuacaucgccuaccugcugcugccccuguucuaccccgccaccuggcuguacggcaagguguacaagagaaucaacagcugccccaacugccugcuggccagccaccccuucaccagcugccccaagaucugcaucugcggcagcagauucagcugcaccgaggcccugaaggugcacagaaugggcaaggacugccugggcuacaagagccugagcaaggccagacagaugugcaagagcaagagcuggagcuucaccgccgccauccugaccggccugauccugauggaguucgugagccccaucgccggcgagagaauguacaagcuggaggagcuggccgacgacuacaucgagcugaccgagcaggugaacauccugggcaaggagaucaagauccugaagcagagcaucaucgugaugcuggccaucauccugauccugcugcugagcgagaacaucaucuucaacuaccuguucaacacccuguacagaagcugcagcaugugcggccugauccacuacagacccggccugaagguggaccugaccaagaccaacaagugcggcagcugcaucugcggcuucgacgagcagcagagcagcggcuucgaguacgagguguuccugaaggacaugcacgugcagagagagagcugcaaguucggccccagagugaaccacuucagaaacaccaagauccugcuguucaccaucgccaucugcaccagcuucuacaccguguacgccgacgaggacugccugagcaagaacaucagaaucaccuaccaggagcugcacaacugcaucggcccccacaucaugggcgacaccugcaugcccaagagcgagcuguacagcgaccugcugagcaagaaccugaucaccgaguacgacaagaaguacuucgagcccggcaccgugaacgaccaguucaacaagaucgaguucgcccaggacgcccacagaaugauccugcuggagagaauccuguacaagaccgagugcgagaugcugagccugaagaagaacagcggccccuacaacguggccuggagaaccuaccugaagaaccacaacaucgaccugugcagcagacacaacuacaagaugaucugccagugcaucaacacccacagcaugugcaagaacaccgacaucgacuucaacaaggagaucgagaccuacuacaaggccaacgccgccgccuacagaagcgacuucaacaccaucaucgacacccugaagaccgccuucagaggccugaccaaggugcugaucgagaacuacaucgagaaggacgacagcgacgcccugaaggcccuguucagcaacaucaccgacagcgugcaggacaacuaccagauggugggcgugcugaaguucgccagcaagcugcugaacaucagccugggcagaaccaccagaagcgcccagcacagcaucaugaccaacgagauccccaagagcaaccccuucaccgacuacagcuacagcagcaucaacaucaaggagugcaugagccccgagagccugaagugcuucaagaagagagacagcgccccccacaccaaccaccugcugugcaagaucgacaacaaguacaaggccuucgacuggcccgagaucgagaccgugcagaagggccagaagcugugccugggcgacagccacugcaaccuggaguucaccgccaucaccgccgacaagaucaugagccugaccaacugcuacaaggagagcuucaccgcccagcccgccgacaugcagaccggcaucaagaagugcagcgccgacgagaucggcgagugcaucacccuggaggacaagagcuggcccaucaucuucugcggcgacaaguacuacuacagcgacggcaaggagcacgccaaggacggcagcaucaacaacuacugccuggccaacaagugcagcgagcagagauuccccauccacaagaacugguucaagaagugcaacugggacaagacccacaaggaguucaccaucaugagacagaucaacuacaacgacaucaccagcuacagaaaggccaucgagagcgagaucggcaccgaccugaugacccaccacuacaagcccaccaagaaccugccccacguggugcccagauaccacagcaucgacgugcagggcaccgagagcaccgagggcaucaucaacggcuucauccagaacaccauccccgccaucagcggccugggcgugggcuaccaccugggcuucaagggcaaccagcuguucgacaucgugaucuucgugaagaaggccguguacaaggcccaguaccagagaguguacaccaccggccccagcaucagcaucaacaucgagcacaacgagaagugcaccggccacugccccgagaagauccccgccaaggagggcuggcugaccuucagcaaggagcacaccagcagcuggggcugcgaggaguacggcugccuggccaucgacaccggcugccuguacggcagcugccaggacgugaucagacccgagcuggacaucuacaagaagaucggcagcgaggccagccugaucgagaucugcaucacccugccccacgagaccuacugcaacgacauggacauccuggagcccaucaucggcgacaagcugagcgccagcuuccagaacacccagaccaaccagcugcccaaccugauggccuacaagaagggcaagguguacaccggccagaucaacgacgugggcaacaccgcccugcagugcggcagcauccagguggugaacggcagcaucaucggcagcggcaaccccaaguucgacuacaucugccacgccaugagaagaaaggacgugaucgugagaaagugcuucaacgacaacuaccagagcugcaccagacuggaccccagaaacgaccugauccccuacagaaagggcgacaucaucgagaucagcaagaccggcagcaacaugggccagaugaccuucaagaucgagcugggcgacaucaacuacaagaucuucaccaagagcguggaccugcagaugagcggcaucugcgccggcugcaucgacugcgccgagggcaucagcugcagcaucaacgccgacgugagcgccgagaccgugugccacugcaagaccaacugcgaggacuucaucagcaacaucgugaucagcccccagaucaagaccuacaacaucaaggugcacugcaagagcaagguggagaagaucaccgccaacaucugcgagagaaacaucgaccugcagcugaccgugaagcccuacaaccagaagaucgaccugagccagcuggacgagagcaacuacaucaaggaggaggaccugcagugcggcaccuggcugugcaaggugcagaaggagggcaucgacaucguguucaagggccuguucagcggccugggcaaguacugggccauccugaucuacagcaucaucggcaucaucguggugauccugcugaucuacgugcugcugcccaucggcagacugcugagagccuuccugaucaagaacgagaucgaguacaccauggagcagaagaucaaguga

SEQ ID NO: 9417 - RNA, 4299 nt, Artificial Sequence
  derived and/or modified CDS sequence (opt4) from OROV/FPV(Aus Ch 16129)__KF697137.1__GP
augaaguucgugagcauccugcuguucgugagcuggcugggcgccaccuaccagaaccccgugagccacagacagaucggcgagagaugcuucgccggcggcagccugaucaagaccgugaaccagaccagcggcgugagcgaggugugcgugagagacgacaucagcaugaucaagagcaucgugcacaccaccaaggccagcgacaccgccgugaacaacuacaucagauucuacagaguguucaucgugaaggaguggcacgacugcaaccccuuccccgaccccaagggcaccuucauggugcuggacgugagcagcaccaaccaccuggagcccaucaccuacaccugcagaacccccugcgagaucacccuggacaaggacagcgccgaggugacccugagcagccagaagaugaaccacuacgagaucagcggcagcaccaucaacaacggcugguucaagaacagcaucagcgugagccuggagcacaccugcgagcacaucaccgugagcugcggccagaagaccgugagauuccacgccugcuucagacagcacagaagcugcaccagauucuucaagaacagcaugaugcccgccagaaugaccgagagcaucugccagaaccuggagaucauccugcugaccugcuucagcuucgugugcuucaucuuccugugcaucaucaccaagaccuacguggccuacgugcugauccccguguucuaccccuucaccuacaucuacggcagacuguacgacaaguacuucaagcugugcgagaacugccugcuggccgugcaccccuucacccccugcgagaccgugugcgugugcggcagccaguacgccaacaccgagcagcugagaacccacagaaugaccaacaacugcaagggcuacaagagccugagcaagagcagagccaugugcaagagcaagggcugcagcuucgugguggccaucuucugcagcaucaucuucuucagcuucaucacccccaucaacagccaggaguacaagcugagcgaccugcccgacgaguucaccagacuggaggaggagaacaccaugcugaagaucagacugcuggugaucaagaucaccaucagcgugaucagcgugaccaucaccgugaccagccugaccgagagaaagguguuccaggagcuguucaacgccaucuacagacacugccccuucugcggcaugauccacagaagaagaggccugagaguggugaacagcaccaccaacaagugcggcaccugcaucugcggcuacaaggaggagaccgagcacggcguggaguacgagaucuuccugaagaccaugcaccaggagaacgugaacugcauguucaagcccagccagagacacuucagaaacuucaagauccugaucgccuuccuggccaugugcaugaucaucaccagcgugagcgccgacgagaagcacugccugaaguacaaggagcccgugaagcugagcaaccugaccgagugccacagccuguggcugaacaucaccgagugccagaucaaccagagcacccuguucgagacccugaagggcgagcagcuggugaccgacuucgacaagcccgacuucaccaucaugggccagaaguacgacaucgccauggagagaaucgagaacgcccagaaccugcaccacaugauccugcuggaguaccugcacgccaagagcaacugccugaaguacaagcagcugaagagcaacagcggccccuacaacauccccuggagaaccuacauccacggccacggccuggacgugugcggccaguacagcuacaagcugaucugcaagugcaucagcaccggcaugcacugcgagaacaccgcccuggacaucuacaacgagaugagacaguucuacaccaacaaccaggagaacuacaaccuggaccugaacaccgugaucaaggccaucggccuggccaugagaggcaucggccagaugaucaucgaggaguucuucggcgagagccagaucgaggagcugagcaacuuccugaacaugaccagcaagaaccugggcaccaacaagcagcugaucggccugaucaacuucggccugaugcugcuggacaucaaccagaccaagaccccccagaucgaccccaagcccagaacccugcaggccagaagcagcauccccaccggcaccgagaucaccgacuggaccaagggccagagcaagaucaagaccugcgccgaguacagcacccugaccugccagagcuggagaaagaccgugaacaccaagagcuuccugaugugcaaggugagcagcaaguggcacguguacaacuggcccgagauccccaccguggugagaaacagcaagcugugccugggcgacuaccacugcaacauggaguucacccccaucgacgccgacgaggcccugaagcagcugagaugcuacaagaccgaguucgugcccagccccgacggcauggacgagagcaucaagaagugcacccuggagaaguucggcggcugcaccaccgccaacggccacagcuggaccaucauggugugcaacggcagauacuaccagaccaacaccagagagcacgccaaggacggccugcugaacagcuacugcuucgagcccaagugccagagcggcagacaccccauccacaagagcuuccugaacaacugcaucuggaaggagagcagcagacagaucaucgagaccagaaccaucgaguacaacaacaucgaggacuacaagaagagcguggagagcgacaucaagagcgaccugaccauccaccacuucaagcccaccaagaaccugccccuggugacccccaccuacaucagcgugguggccgacggcaccauggugagcgacggcauccagaacgccuacgugaagggcaccauccccggcaucagcggcguggccaccggccugcacgugaagacccccgacggcauccugcugauggacaucaucguguacgugagaaaggcccuguacaaggccaacuacgagaagaucuacagcaccggccccaccaucggcaucaacgugaagcacaacgagaagugcaccggcaccugccccgagcacauccccaaggacgagggcuggcugaccuucagcaaggagcacaccagcaacuggggcugcgaggaguacggcugcuucgccaucaacagcggcugccuguacggcagcugccaggacaucaucagacccgagcuggacaucuacaagcagcagggcgaggagcagacccugcuggagcugugcaucacccugccccacgagaccuucugcaacgaccuggacgugcuggagcccgugaucaccgacaagcugcagcuggacuuccagaccacccagagcgaccaccugcccgagcugguggcccugaagaagggccugauccugaccggccagcugaacgaccugggcaacaccgccgccaugugcggcagcgugcagcuggugaacaagaccaucuacggccagggcaaccccaaguucgacuucaucugccacgccaugagaagaaaggacgugaucgugagaagaugcuacgacaaccacuacagcaccugcgcccugcugaagcagagaaacgaccugcugcacaaggaggugaacgaccagaugagcaucaccgugaacggcaagaaccugggccugaucaacuucagacugaaccugggcgaccugaacuacaagcuguucgugaacgagcccaacuucgagcugaccggccagugcgccggcugcaucagcugcgccgacgagaucagcugccagcugaacaucaucgccgaccacgaguucaccugcaaggugagcagcagcugcaaccuguacaucagcaacaugaugaucacccccgccaaccacaucuacaaccugaaggugagcugcagagagcacgugagcaacaucgaccuggccgugugcggcagaagcuucagccugcacgccacccugaagcagcacagccagaagcuggaccugagcgcccuggacgagaccaacuucgugaaggaggaggaccugagaugcggcaccuggcugugcaaggugaaggacgagggccugagcuuccugaccagaagcaucuucggcagccugggcaccuacuggagcuacuucaucuacggccugaucuucaugauccugcuguucaucgccaucuacuuccuguacccccugugcaagagacugaagggccugcuggaggagaacgagagagaguaccugaucgagagcaagaugaaguga

SEQ ID NO: 9418 - RNA, 4257 nt, Artificial Sequence
  derived and/or modified CDS sequence (opt4) from OROV/IQTV(IQT9924)__KF697143.1__GP
auggacugcaucaucuucuaccugagcuucuucgccguggugaccgcccaccccgugagccaccaccaggugggcgacagaugcuucgccggcggcaaccugaucaaggaccugaacaagaccgugaacaucggcgaggugugcgugagagacgacaucagcaucaucaagagcaccaccgccauccagaagagccuggaccaccugagcaccagaaccaaguucuacagaguguacaucgugaaggagugggccgagugcaaccccaucaucgacuacgccggcaacuucaucgugaugaacaucgacgacaacggccaccuggugcccagaaugcacaccugcagagccagcugcgacaucagacugaacaagaacgacgccgagaucauccugagcagccagaagaccaaccacuacgagaucaucggcaccaccaccgugagcggcugguucaagaacaccaucaaccugccccuggagcacaccugcgagcacaucaccgugaacugcggccagaagagccugagauuccacgccugcuucagaaugcacagaggcugcaccagauucuucaagaacaccuacaugcccagcaccaugaucgagcacaugugcgugaaccuggagcugaucaucuucacccuguacaucuucaccgcccugguguucgccuacaucaucaccaagagcuacaucgccuacauccugcugccccuguucuacccccugaccuacguguucggcaucaucuacagcaagcugaagcagugcaagaccugcaugcuggccgcccaccccuucaccaacugccccaagagaugcgugugcggcagcagauucaacugcaccgaggcccugagagugcacagacugggcagagacugccagggcuacaagagccugagcaaggccagacagaugugcaagagcaagagcuggagcuucaucaucgccaucuucaccggccugauccugauggaguucaucacccccauccacggcgagagaaccuacaagcugagcgagcuggccgacgaguucaucgccaugaagaccgaggugaccgugaugcagagaagcaucuacaaccagaagauccugaacaucgcccugcugacccugguggugcugaucauccugcuggagaccuacaucuucaagauccuguucagccugcuguacagaagcugcagcaugugcggccugauccacuacaaggugggccugaagaucaaccugcugaccaccaacaagugcggcaccugcaucugcggcuucagcgagcagcagagcagcggcuucgaguacgagguguuccugaaggacaugcacaagcagagagagagcugcaaguacuuccccaugcugaaccacuucagaaaccugaagauccugaccaccauccugcugcugauccugcuggccaccagcgugagcagcgagugccugcagaagccccugaagaucaagcuggaggaccugcacgagugcaucggcgugaacuuccuggacaagcagugcuacaacagaaagaaccuguacgagagccugagaagcaagaaccugaucagcgagguggacaagaaguacuucgagaacgccgaccuggagggccaguucaagagaaucgaguacgcccaggacgcccacagaaugauccugcuggagagaauccuguacagcaccgagugcgagaugcacaccauccugaccaacggcggcgccuacaacauccccuggagaaccuaccugaagaaccacaaccugaaccugugcggcaagcacgugcacaagauggugugccagugcgugaacacccacacccagugccugagcaccggcaucgacuaccaggacgagaucaccaaguucuaccaggccgacggcgacagcuacagaagcgaccugagcaucauccuggagaccaucagcaccgccuucagaggccugaccaaggugcugaucgagaccuacaucgagcaggacaacagcgagagcaugaucaagcugcugaacaccauccagggcaaggugcccaacaacuaccagaugcugggcauccugaaguucgccaucaagaucaugaacaucaaccagaccagaggcgugagaagcgccagacacaccaucgugagcaacgacauccccaugagcgagcccuucagcaacuucgaggugagcaacaucaacaucaagcagugccuggagccccugacccugaagugcuucaccaagagaggcgacagcccccacagcaaccaccugcugugcaaggagcagagcaaguacaagguguucgaguggcccgagguggagaccgugaccaagaacaacaagcugugccugggcgacacccacugcaaccugaaguucaccgccaccaccagcgacgagaucaucaagcugcugaacugcuucagcgacaccuacaagcccaaccccggcgagauggagaucggccugaagaagugcaacgccgagaagaucggcgagugcgugacccuggagaacagccccuggcccaucguguacugcgagaacaaguacuacuacagcgaggccaaggagcacgccaaggacggcagcgugaacagcuacugccugaccaacaagugcaccgaggacagacugcccaucaaccccgccugguucaagagcugcaacugggagaagaacaucaaggagaccgccaccaucaaggaguucguguacaacgacaucaagagcuacagaaagagccuggagagcgagaucaacaccgaccugaugauccaccacuacagacccaccaagaaccugccccacaucaagcccaucuacaagagccugagcauccagggcagcgagaccguggacggccugcagaacagcuucaucgagggcgagaugcccgccaucagcggccuggccaacggcuaccaccugauguacaagggcacccagcuguucgacaucgugaucuucaucagaaaggccguguacaaggccaacuacuacaagaucuacaccaccggccccagcaucgccaucaacauggagcacaacgagcagugcaccggccacugccccagcaagauccccagcaaggagaacuggcugaccuucagcagagagcacaccagcagcuggggcugcgaggaguacggcugccuggccaucgacaccggcugccuguacggcagcugccaggacgugaucagacccgagaucgacguguacaagaagagcggcaccgagcagagccugaucgagcugugcaucaccagcgcccacgagaccuucugcaacgaccuggacauccuggagcccaucaucggcgagaagaucagcgccagcuuccagagcacccagagcaaccagcugcccaacaucaucgccuucagaaagggccagauccugaccggcgccaucaacgaccugggcaacaccggcagccagugcggcagcauccagcuggugaacaacacccugcugggcgagggcaacgugaaguucgacuacaucugccacgccaugagaagaaaggacgugaucaucagaagaugcuacaacgaccacuucaccagcugcaaccugcugcagaagagaagcgaccugaucggcaacaucaacggcaaggagcugcagaucagcaugagcggcagaagcaugggcagcaugaaguucaagaucgagcugggcgacaucaacuacaagcuguacaccgagaacgccgacaucaccaucagaggcgagugcggcggcugcaucggcugcgccgaggccgugagcugcagccuggagguggagagcgccagcgagauccugugcaagguggagugcaacugccagcccuacaucgagaacauccugaucaagccccagaccaagaccuacagcuucaaggccaccugccuggagaagagcaacacccuggacaucaagaucugcggcaagcagaucaucgccccccugaccaucaagagcuacaaccagaagaucgaccugagcaagcuggacgagagcaacuacgugaaggaggaggaccuggccugcaacaccuggcugugcaaggugcagaccgagggcuucaacuucguguucagcggccuguucgccggcuucggcagauacuggaccaucgccaucuacauccugaucgccguggugaucauccugauccugaucuacauccugaugcccaucuucagacugaucagaaccuuccugaucaagaacgagaucgaguacaccaccgagcagaagaugagauga

SEQ ID NO: 9419 - RNA, 4257 nt, Artificial Sequence
  derived and/or modified CDS sequence (opt4) from OROV/IQTV(MIS-0397)__KJ866387.1__GP
auggacugcaucaucuucuaccugagcuucuucgccguggugaccgcccaccccgugagccaccaccaggugggcgacagaugcuucgccggcggcaaccugaucaaggaccugaacaagaccgugaacaucggcgaggugugcgugagagacgacaucagcaucaucaagagcaccaccgccauccagaagagccuggaccaccugagcaccagaaccaaguucuacagaguguacaucgugaaggagugggccgagugcaaccccaucaucgacuacgccggcaacuucaucgugaugaacaucgacgacaacggccaccuggugcccagaaugcacaccugcagagccagcugcgacaucagacugaacaagaacgacgccgagaucauccugagcagccagaagaccaaccacuacgagaucaucggcaccaccaccgugagcggcugguucaagaacaccaucaaccugccccuggagcacaccugcgagcacaucaccgugaacugcggccagaagagccugagauuccacgccugcuucagaaugcacagaggcugcaccagauucuucaagaacaccuacaugcccagcaccaugaucgagcacaugugcgccaaccuggagcugaucaucuucacccuguacaucuucaccgcccugguguucgccuacaucaucaccaagagcuacaucgccuacauccugcugccccuguucuacccccugaccuacguguucggcaucaucuacagcaagcugaagcagugcaagaccugcaugcuggccgcccaccccuucaccaacugccccaagagaugcgugugcggcagcagauucaacugcaccgaggcccugagagugcacagacugggcagagacugccagggcuacaagagccugagcaaggccagacagaugugcaagagcaagagcuggagcuucaucaucgccaucuucaccggccugauccugauggaguucaucacccccauccacggcgagagaaccuacaagcugagcgagcuggccgacgaguucaucgccaugaagaccgaggugaccgugaugcagagaagcaucuacaaccagaagauccugaacaucgcccugcugacccugguggugcugaucauccugcuggagaccuacaucuucaagauccuguucagccugcuguacagaagcugcagcaugugcggccugauccacuacaagcugggccugaagaucaaccugcugaccaccaacaagugcggcaccugcaucugcggcuucagcgagcagcagagcagcggcuucgaguacgagguguuccugaaggacaugcacaagcagagagagagcugcaaguacuuccccaugcugaaccacuucagaaaccugaagauccugaccaccauccugcugcugauccugcuggccaccagcgugagcagcgagugccugcagaagccccugaagaucaagcuggaggaccugcacgagugcaucggcgugaacuuccuggacagacagugcuacaacagaaaggaccuguacgagagccugagaagcaagaaccugaucagcgagguggacaagaaguacuucgagagcgccgaccugggcggccaguucaagagaaucgaguacgcccaggacgcccacagaaugauccugcuggagagaauccuguacagcaccgagugcgagaugcacaccauccugaccaacggcggcgccuacaacauccccuggagaaccuaccugaagaaccacaaccugaaccugugcggcaagcacgugcacaagauggugugccagugcgugaacacccacacccagugccugagcaccggcaucgacuaccaggacgagaucaccaaguucuaccaggccgacggcgacagcuacagaagcgaccugagcaucauccuggagaccaucagcaccgccuucagaggccugaccaaggugcugaucgagaccuacaucgagcaggacaacagcgagagcaugaucaagcugcugaacaccauccagggcaaggugcccaacaacuaccagaugcugggcauccugaaguucgccaucaagaucaugaacaucaaccagaccagaggcgugagaagcgccagacacaccaucgugagcaacgacauccccaugagcgagcccuucagcaacuucgaggccagcaacaucaacaucaagcagugcagcgagccccugacccugaagugcuucaccaagagaggcgacagcccccacagcaaccaccugcugugcaaggagcagagcaaguacaagguguucgaguggcccgagaucgagaccgugaccaagaacaacaagcugugccugggcgacacccacugcaaccugaaguucaccgccaccaccagcgacgagaucaucaagcugcugaacugcuucagcgacaccuacaagcccaaccccggcgagauggagaucggccugaagaagugcaacgccgagaagaucggcgagugcgugacccuggagaacagccccuggcccaucguguacugcgagaacaaguacuacuacagcgaggccaaggagcacgccaaggacggcagcgugaacagcuacugccugaccaacaagugcaccgaggacagacugcccaucaaccccgccugguucaagagcugcaacugggagaagaacaucaaggagaccgccaccaucaaggaguucguguacaacgacaucaagagcuacagaaagagccuggagagcgagaucaacaccgaccugaugauccaccacuacagacccaccaagaaccugccccacaucaagcccaucuacaagagccugagcauccagggcagcgagaccguggacggccugcagaacagcuucaucgagggcgagaugcccgccaucagcggccuggccaacggcuaccaccugaccuacaagggcacccagcuguucgacaucgugaucuucaucagaaaggccguguacaaggccaacuacuacaagaucuacaccaccggccccagcaucgccaucaacauggagcacaacgagcagugcaccggccacugccccagcaagauccccagcaaggagaacuggcugaccuucagcagagagcacaccagcagcuggggcugcgaggaguacggcugccuggccaucgacaccggcugccuguacggcagcugccaggacgugaucagacccgagaucgacguguacaagaagagcggcaacgagcagagccugaucgagcugugcaucaccagcgcccacgagaccuucugcaacgaccuggacauccuggagcccaucaucggcgagaagaucagcgccagcuuccagagcacccagagcaaccagcugcccaacaucaucgccuucagaaagggccagauccugaccggcgccaucaacgaccugggcaacaccggcagccagugcggcagcauccagcuggugaacaacacccugcugggcgagggcaacgugaaguucgacuacaucugccacgccaugagaagaaaggacgugaucaucagaagaugcuacaacgaccacuucaccagcugcaaccugcugcagaagagaagcgaccugaucggcaacaucaacggcaaggagcugcagaucagcaugagcggcagaagcaugggcagcaugaaguucaagaucgagcugggcgacaucaacuacaagcuguacaccgagaacgccgacaucaccaucagaggcgagugcggcggcugcaucggcugcgccgaggccgugagcugcagccuggagguggagagcagcagcgagauccugugcaagguggagugcaacugccagcccuacaucgagaacauccugaucaagccccagaccaagaccuacagcuucaaggccaccugccuggagagaagcaacacccuggacaucaagaucugcggcaagcagaucaucgccccccugaccaucaagagcuacaaccagaagaucgaccugagcaagcuggacgagagcaacuacgugaaggaggaggaccuggccugcaacaccuggcugugcaaggugcagaccgagggcuucaacuucguguucagcggccuguucgccggcuucggcagauacuggaccaucgccaucuacauccugaucgccguggugaucauccugauccugaucuacauccugaugcccaucuucagacugaucagaaccuuccugaucaagaacgagaucgaguacaccaccgagcagaagaugagauga

SEQ ID NO: 9420 - RNA, 4257 nt, Artificial Sequence
  derived and/or modified CDS sequence (opt4) from OROV/MDDV(FMD 1303)__KF697145.1__GP
auggccuuccugcugaucuacguggugcuggccgccgccguggccagccacccccugagcaaccaccagaucggcgacagaugcuucgccggcggcaaccugaucagagagcugaacaagaccgugaacaucggcgagcugugcgugagagacgacaucagcaugaucaagagcaccaccgccauccagaagagcgugggccaccugagcaccagaaccaaguucuacagaguguacaucgugaaggagugggccgagugcaaccccaucaucgacuucgccggcaacuucaucaucaugaacaucgacgagaacggccaccuggugcccaagaugcacaccugcagagccagcugcgacaucagacugaacaaggacgacgccgagaucauccugagcagccagaagaccaaccacuacgagaucaucggcaccaccagcaucagcggcugguucaagaacaccaucaaccugccccuggagcacaccugcgagcacaucaccgugaacugcggccagaagagccugagauuccacgccugcuucagaaugcacagaggcugcaccagauucuucaagaacaccuacaugcccagcaccaugaucgagaccaugugcgugaaccuggagcugaucaucuucacccuguacaucuucagcgccgccguguucgccuacgugaucaccaagagcuacaucgccuacauccugcugcccguguucuaccccaucaccuacauccugggcagcaucuacagcagauucaagcagugcaagaccugcaugcuggccgcccaccccuucaccagcugccccaagaagugcgugugcggcagcagauucaacugcaccgaggcccugagagugcacagacugggcaaggacugccagggcuacaagagccugagcaaggccagacagaugugcaagagcaagagcuggagcuucaucaucgccguguucaccggccugauccugauggaguucaucacccccaucagcggcgagagaauguacaagcugagcgagcuggccgaggaguucaucgagaugaaggaggaggccagcgcccugaagaaggccaucaacaaccugaagcugcugaacgugcugcugagcgccaucgccacccuggugguggugauggagaccuacaucuucaagagccuguucaaccugcuguacagaagcugcagcaugugcggccugauccacuacaagaucggccugagagugaaccugcugaccaccaacagaugcggcaccugcaucugcggcuucaacgagcagcagagcagcggcuucgaguacgagaucuuccugaaggacaugcacaagcagagagagagcugcaaguacuuccccaugcugaaccacuucagaaacgugaagauccugaccguguuccugcugcugaccaugcugaccgccagcgccagcagcgagugccugcagaagccccugaagaucaagcuggaggaccugcacgagugcaucggcgugaacuuccugaacagacagugcuacaacagccaggagcuguaccagagccugaagagcaagaaccuggugagcgagguggacaagaaguacuucgacaacaagaaccuggaggaccuguucaagagaaucgaguacgcccaggacgcccacagaaugauccugcuggagagaauccuguacagcaccgagugcgagaugcacaccauccugaccaacggcggcgccuacaacauccccuggagaaccuaccugaagaaccacaaccugaaccugugcggcaagcacgugcacaagauggugugccagugcaucaacacccacacccagugccugagcaccggcaucgacuaccaggacgagaucaccaaguucuaccaggccgacggcgacagcuacagagccgaccugagcgugauccugcagaccaucgccaccgccuucagaggcaugaccaaggugcugaucgagaccuacaucgagcaggacaacagcgagagcaugaucaagcugcugaacaccaucaaggagaaggugcccaacaacuaccagaugcugggcauccugaacuucgccaucaagaucaugagcgugaaccagaccagaggcgugagaagcgccagacacaccaucaucagcaacgacauccccaugagcgagaccuucagcaacuucgaggugagcaacaucgacgugaagcagugcaccgacccccugacccugaagugcuucaccaagagaggcgacgccccccacagcaaccaccugcugugcaaggagcagaacaaguacaagguguucgaguggcccgagaucgagaccgugaugaagaacaacaagcugugccugggcgacacccacugcaaccugaaguucgccgccaucgccagcgacgaggugaucaagcugcugaacugcuucagcgacaccuacaagcccaaccccggcgagauggaggugggcgccaagaagugcaacgccgacaagaucggcgagugcaucacccuggagaacaaccccuggcccaucguguacugcgagaccaaguacuacuacagcgacgccaaggagcacgccaaggacggcaacgugaacagcuacugccugaccaacaagugcaacgaggacagauuccccaucaaccccaccugguucaagagcugcagcugggacagaaacgugaaggagaccaccaccaucaaggaguucgugcacaacgacaucagcgccuacagaaagagccuggagagcgagaucagcaccgaccugcugauccaccacuacagacccaccaagaaccugccccacaucaugcccgccuacaagagccugaccauccagggcagcgagaccguggacggccugcagaacagcuucaucgagggcgagaugcccgccaucagcggccuggccaacggcuaccaccugaaguacaagggcaucgagcuguucgacaucgugaucuucaucagaaaggccguguacaaggccaacuacuacaagaucuacaccaccggccccagcguggccaucaacauggagcacaacgagcagugcaccggcagcugccccaagaagauccccgccaaggagaacuggcugaccuucagcaaggagcacaccagcagcuggggcugcgaggaguacggcugccuggccaucgacaccggcugccuguacggcagcugccaggacgugaucagacccgagguggacguguacaagaaggccagcgccgagcagagccugaucgagcugugcaucaccagcgcccacgagaccuucugcaacgaccuggacauccuggagcccaucaucggcgacaagaucagcgccgccuuccagagcacccaggugaaccagcugcccaacaucaucgccuucaagaagggccagaucuucaccggcgccaucaacgaccugggcaacaccggcagccagugcggcagcauccagcugaucaacaacacccugcugggcgagggcaacgugaaguucgacuacaucugccacgccaugaagagaaaggacgugaucgugagaagaugcuacaacgaccacuucgccagcugcaaccugcugcagaagagaagcgaccuggugggcacccugaacggcaaggagcugcaggugagcaugagcggcagaagcaugggcagcaugaaguucaagguggagcugggcgacaucagcuacaagcuguacaccgagaacgccgacaucagcaucagcggcgagugcggcggcugcaucaacugcgccgaggccaucagcugcgcccuggagaucgacagcagcaccgaggugcugugcaagcuggagugcagcugccagcccuacauccagaacauccugaucaagccccaggugaagaaguacagcuucaaggccaccugcuucgagaagagaaacagccuggaggugaccgugugcaagaagcagcacaccaucccccugaccaucaagagcuacaaccagaagaucgaccugagcagacuggacgagagcaacuacgugagagaggaggaccugaccugcaacaccuggcugugcaagguggagaaggagggcaucggcgugauguucagcggccuguucgccggcuucggcaaguacuggagcaucgccaucuacgcccugaucgcccuggugaucuuccugauccugaucuacauccuggugcccaucuucagacugaucagaaccuuccugaucaagaacgagguggaguacaccaccgagcagaagaugagauga

SEQ ID NO: 9421 - RNA, 4257 nt, Artificial Sequence
  derived and/or modified CDS sequence (opt4) from OROV/MDDV(INHRR 17a-10)__KJ866390.1__GP
auggccuuccugcugaucuacguggugcuggccgccaccguggccagccacccccugagcaaccaccagaucggcgacagaugcuucgccggcggcaaccugaucagagagcugaacaagaccgugaacaucggcgagcugugcgugagagacgacaucagcaugaucaagagcaccaccgccauccagaagagcgugggccaccugagcaccagaaccaaguucuacagaguguacaucgugaaggagugggccgagugcaaccccaucaucgacuucgccggcaacuucaucaucaugaacaucgacgagaacggccaccuggugcccaagaugcacaccugcagagccagcugcgacaucagacugaacaaggacgacgccgagaucauccugagcagccagaagaccaaccacuacgagaucaucggcaccaccagcaucagcggcugguucaagaacaccaucaaccugccccuggagcacaccugcgagcacaucaccgugaacugcggccagaagagccugagauuccacgccugcuucagaaugcacagaggcugcaccagauucuucaagaacaccuacaugcccagcaccaugaucgagaccaugugcgugaaccuggagcugaucaucuucacccuguacaucuucagcgccgccguguucgccuacgugaucaccaagagcuacaucgccuacauccugcugcccguguucuaccccaucaccuacauccugggcagcaucuacagcagauucaagcagugcaagaccugcaugcuggccgcccaccccuucaccagcugccccaagaagugcgugugcggcagcagauucaacugcaccgaggcccugagagugcacagacugggcaaggacugccagggcuacaagagccugagcaaggccagacagaugugcaagagcaagagcuggagcuucaucaucgccguguucaccggccugauccugauggaguucaucacccccaucagcggcgagagaauguacaagcugagcgagcuggccgaggaguucaucgagaugaaggaggaggccagcgcccugaagaaggccaucaacaaccugaagcugcugaacgugcugcugagcgccaucgccacccuggugguggugauggagaccugcaucuucaagagccuguucaaccugcuguacagaagcugcagcaugugcggccugauccacuacaagaucggccugagagugaaccugcugaccaccaacagaugcggcaccugcaucugcggcuucagcgagcagcagagcagcggcuucgaguacgagaucuuccugaaggacaugcacaagcagagagagagcugcaaguacuuccccaugcugaaccacuucagaaacgugaagauccugaccguguuccugcugcugaccaugcugaccgccagcgccagcagcgagugccugcagaagccccugaagaucaagcuggaggaccugcacgagugcaucggcgugaacuuccugaacagacagugcuacaacagccaggagcuguaccagagccugaagagcaagaaccuggugagcgagguggacaagaaguacuucgacaacaagaaccuggaggaccuguucaagagaaucgaguacgcccaggacgcccacagaaugauccugcuggagagaauccuguacagcaccgagugcgagaugcacaccauccugaccaacggcggcgccuacaacauccccuggagaaccuaccugaagaaccacaaccugaaccugugcggcaagcacgugcacaagauggugugccagugcaucaacacccacacccagugccugagcaccggcaucgacuaccaggacgagaucaccaaguucuaccaggccgacggcgacagcuacagagccgaccugagcaucauccuggagaccaucgccaccgccuucagaggcaugaccaaggugcugaucgagaccuacaucgagcaggacaacagcgagagcaugaucaagcugcugaacaccaucaaggagaaggugcccaacaacuaccagaugcugggcauccugaacuucgccaucaagaucaugagcgugaaccagaccagaggcgugagaagcgccagacacaccaucaucagcaacgacauccccaugagcgagaccuucaccaacuucgaggugagcaacaucgacgugaagcagugcaccgacccccugacccugaagugcuucaccaagagaggcgacgccccccacagcaaccaccugcugugcaaggagcagaacaaguacaagguguucgaguggcccgagaucgagaccgugaugaagaacaacaagcugugccugggcgacacccacugcaaccugaaguucgccgccaucgccagcgacgaggugaucaagcugcugaacugcuucagcgacaccuacaagcccaaccccggcgagauggaggugggcaccaagaagugcaacgccgacaagaucggcgagugcaucacccuggagaacaaccccuggcccaucguguacugcgagaccaaguacuacuacagcgacgccaaggagcacgccaaggacggcaacgugaacagcuacugccugaccaacaagugcaacgaggacagauuccccaucaaccccaccugguucaagagcugcagcugggacagaaacgugaaggagaccaccaccaucaaggaguucgugcacaacgacaucagcgccuacagaaagagccuggagagcgagaucagcaccgaccugcugauccaccacuacagacccaccaagaaccugccccacaucaugcccgccuacaagagccugaccauccagggcagcgagaccguggacggccugcagaacagcuucaucgagggcgacaugcccgccaucagcggccuggccaacggcuaccaccugaaguacaagggcaucgagcuguucgacaucgugaucuucaucaagaaggccguguacaaggccaacuacuacaagaucuacaccaccggccccagcguggccaucaacauggagcacaacgagcagugcaccggcagcugccccaagaagauccccgccaaggagaacuggcugaccuucagcaaggagcacaccagcagcuggggcugcgaggaguacggcugccuggccaucgacaccggcugccuguacggcagcugccaggacgugaucagacccgagaucgacguguacaagaaggccagcgccgagcagagccugaucgagcugugcaucaccagcgcccacgagaccuucugcaacgaccuggacauccuggagcccaucaucggcgacaagaucagcgccgccuuccagagcacccaggugaaccagcugcccaacaucaucgccuucaagaagggccagaucuucaccggcgccaucaacgaccugggcaacaccggcagccagugcggcagcauccagcugaucaacaacacccugcugggcgagggcaacgugaaguucgacuacaucugccacgccaugaagagaaaggacgugaucgugagaagaugcuacaacgaccacuucgccagcugcaaccugcugcagaagagaagcgaccuggugggcacccugaacggcaaggagcugcaggugagcaugagcggcagaagcaugggcagcaugaaguucaagguggagcugggcgacaucagcuacaagcuguacaccgagaacgccgacaucagcaucagcggcgagugcggcggcugcaucaacugcgccgaggccaucagcugcgcccuggagaucgacagcagcaccgaggugcugugcaagcuggagugcagcugccagcccuacauccagaacauccugaucaagccccaggugaagaaguacagcuucaaggccaccugcuucgagaagagaaacagccuggaggugaccgugugcaagaagcagcacaccaucccccugaccaucaagagcuacaaccagaagaucgaccugagcagacuggacgagagcaacuacgugagagaggaggaccugaccugcaacaccuggcugugcaagguggagaaggagggcaucggcgugauguucagcggccuguucgccggcuucggcaaguacuggagcaucgccaucuacgcccugaucgcccuggugaucuuccugauccugaucuacauccuggugcccaucuucagacugaucagaaccuuccugaucaagaacgagguggaguacaccaccgagcagaagaugagauga

SEQ ID NO: 9422 - RNA, 4257 nt, Artificial Sequence
  derived and/or modified CDS sequence (opt4) from OROV/Perdoes virus(BeAn789726)__KP691625.1__GP
auguucauccaguucaaccuggccuucuucugccugagcaucgugugcggccacccccugaccaaggaccacaucggcgacagaugcuucgccggcggcaaccuguucaaggagaucacccagaccaccggccugagcgagaucugcaucaaggacgacaucagcaucaucaagagccagguggagaucaagaagcagagcagcgaggugaccuacgccgugaaguucuacagaguguaccuggugaaggaguggagcgagugcaaccccauccaggaccagcacggcagcaucaugauccuggacgugaccaacaccggccugaucgugcccaagauguacaccugcagagccgccugcgacaucacccuggacaaggacaacgccgaggugguguucaucagccagaagaacaacaacuacgagcuggccggcaccaccgugaugcacggcugguucaagaacguggugagcaucaagcuggagcacaccugcgagcaccugaccgccaccugcggccagaagaccgugaaguuccacgccugcuucagacagcacagagccugcgccagauuccugaagaccaccuacaugcccaucgugaugguggagagccugugcagcaaccuggagcuggugaucuucaucaccuacaucuucgugugccuggccuucgccuucaucaucaccagaaccuacguggccuaccugcugauccccguguucuaccccuucaccuacgccuacggcaagauguaccugaagugcgugaagaccugccccaacugccugcuggccaugcaccccuucaccaacugcaccaaccugugcaucugcggcagcagauucagcaacaccgagagccugaaggugcacagacugggcaacugcuacggcuacaaggcccugagcggcgccagaagcaugugcaagagcaaggugagcagcuucaccaccgccauguucuucggcaucaucauccugagcuucaucgccccccugaacggcgagagacuguacaagcugagcgagcugcccgacgaguacaucgagauggagagcaccaucgagggcagcaagcagaaggagaccaucguggacaucaucaacuacaccgcccuggugcugauccugaucaccauccugcugcagggcauccuggagaacuacaucuucagacugaaguucagauucugcagcuucugcgacaugauccacaugaagaagaaccugaagaucuucagcaacaugaccaacaagugcggcaccugcaucugcggcuucaaccaggagaucagaagcggcuucgacuacgagguguucaucaaggacaugcacgugagcagagagagcugcaaguacaacuaccacaagaacuacagcuucuacaucaagaugcugcugguggugcugcuggugccccugaucggcaccaccgccgccgaggacaccaagugccugaaguacgaccugaacaagaacaucgaggaccugaaggacugcuacggccugaagcugaacaucgacaagcacgacaccguggagaacgccuacaagaaccugguggaccagaagcuggugagcgagcuggacagacuggaccugaacaucaugcugggcagcaaggagagcaucuucgaggccaucgagaccagcaugaacauccaccagaugguguuccuggaguaccuggccuacaagaccgaccccaagcugagcgagaucaagcagaacaccggccccuacaacaucgccuggagaaccuucauccacggcaacagccuggaggugugcggcaacuaccccuacaagcugaucugcuacugcaucaaccagaagacccacugcgagaacagcaccguggacuacggcauccagauccagcccuucuacaaccagcaccccaacagcuacaagagcgacauggaggcccugaucaagaccgugcagaucgccuucagaggcaucaucaaggugcugauccaguacuacguggagaacaacaagaccagcgagcugagcaaccugcugaccgagcugagaaacgugaugggcaacaacauccagaugaagggcauccugaaguaccuggagaccuaccugaagaagccccugcugauggccagaaccaucagaaucgccgccaagguggacaccagcggcgaccccuacaacaacuucagcaccagcaaggagaacaucaccaagugcaucaagauccagaagcugagaugcaucaccaagcugaccagaaucgagcacaacuacauccugugcggcgacagcgagaagaagcuguaccaguggcccgccaagcccaccaucguggacgacaacgacgccugccugggcgacaagcacugccaccugcccuucauccccaucggcaacgacgaggccaucaagaccgugaacugcuacguggagguguacgagcagaaccccggcgacaugaacagcuaccagaagaagugcgacgccaugaacgugggcaccugccugaccaucaagaacgagaacuggcccaucgugcagugcaagaccggcaaguacuacuacgccgacggcagaauccacgccaaggacggcaccaucaacaccuacugcuucagcgagaagugcaacgccgacagauaccccauccaccaggacuacaucaacagcugcaacuggcaggagaccaucaaggacuuccagcacgugagagaguucgugcaccuggacaucgagagcuacaagaaggccaucgagagcgacaucaagaccgaccugguggugcacaaguucagacccgugaagaaccugccccacgugauccccaucuacaagagcaucaccgugcagggcaccgagaccagcgacggcauccagaacgccuucauccagggcagcaugcccgccaucagcggccuggccaacggcuaccaccuguucacccccgacagcaagcagcuguucgacguggugcuguuccugagaaaggccagcuacaaggccgaguacagaaagaucuacagcaccggccccaccaucggcaucaacguggagcacaacgagaagugcaccggcagcugccccaagaccaucgacaagaaggacaacuggcugaccuucagcaaggagcacaccagccaguggggcugcgaggaguacggcugccuggccaucaacaccggcugcguguucggcagcugccaggacaucaucagacccgagaucgacguguacaagaugcacggcgccgagagaagcgugguggagcugugcaucacccugccccacgagaccuacugcaacgaccuggacgugcuggagcccaucaucggcgacaagauccaggccgccuuccagaccgugcagagcaaccacaugcccagacugauggccaucaagaacaacaaggccuucaccggccagaucaacgaccugggcagcaccgccagcuacugcggcagcgugcagaaguucaacgagaccaucaucggccagggcgaccccaaguucgacuacgugugccaccugcugaagagaaaggacaucaucgugagaagaugcuacagcaacaacuacgagagcugcaagcugcugacccccagagccgacaucaucguggacaagaagggcgagagccugcaggccagcaucgugggccugaaccugggccagaugaacuucaagaucaugcugggcgacaucaacuacaagcaguacaccgagagcaacaaccuggaggccaccggccagugcgugggcugcguggacugcagcgaggacaucgugugcaaccugaagaucgagagccagagcgagagcgugugcaacaucaagagcgacugcaaccuguaccugagcagcaugcugauccagcccaccgugggcgaguacaaccugaagaugagcugcaacgccaagcuggacaaggugaacaucgagaucugcaagcagaaguucgugcugccccugaccaucaagagccacaaccagaagaucgaccugagcaagcuggacgagagcaacuacaucagagaggaggaccugaagugcgacaccaugaucugcaaggugaaggacgagggccugagcuucaucaccaacagccuguucggcggcaucagcuacuucuggaagauccugaucagcagccugaucgugaucuuccugaucauccuguucuacuacgugggccugcccauccugagacugaucaaggacuaccugaaggagaacgagcuggaguaccuggccgagggcaaguga

SEQ ID NO: 9423 - RNA, 4257 nt, Artificial Sequence
  derived and/or modified CDS sequence (opt4) from OROV/Perdoes virus(BeAn790177)__KP691628.1__GP
auguucauccaguucaaccuggccuucuucugccugagcaucgugugcggccacccccugaccaaggaccacaucggcgacagaugcuucgccggcggcaaccuguucaaggagaucacccagaccaccggccugagcgagaucugcaucaaggacgacaucagcaucaucaagagccagguggagaucaagaagcagagcagcgaggugaccuacgccgugaaguucuacagaguguaccuggugaaggaguggagcgagugcaaccccauccaggaccagcacggcagcaucaugauccuggacgugaccaacaccggccugaucgugcccaagauguacaccugcagagccgccugcgacaucacccuggacaaggacaacgccgaggugguguucaucagccagaagaacaacaacuacgagcuggccggcaccaccgugaugcacggcugguucaagaacguggugagcaucaagcuggagcacaccugcgagcaccugaccgccaccugcggccagaagaccgugaaguuccacgccugcuucagacagcacagagccugcgccagauuccugaagaccaccuacaugcccaucgugaugguggagagccugugcagcaaccuggagcuggugaucuucaucaccuacaucuucgugugccuggccuucgccuucaucaucaccagaaccuacguggccuaccugcugauccccguguucuaccccuucaccuacgccuacggcaagauguaccugaagugcgugaagaccugccccaacugccugcuggccaugcaccccuucaccaacugcaccaaccugugcaucugcggcagcagauucagcaacaccgagagccugaaggugcacagacugggcaacugcuacggcuacaaggcccugagcggcgccagaagcaugugcaagagcaaggugagcagcuucaccaccgccauguucuucggcaucaucauccugagcuucaucgccccccugaacggcgagagacuguacaagcugagcgagcugcccgacgaguacaucgagauggagagcaccaucgagggcagcaagcagaaggagaccaucguggacaucaucaacuacaccgcccuggugcugauccugaucaccauccugcugcagggcauccuggagaacuacaucuucagacugaaguucagauucugcagcuucugcgacaugauccacaugaagaagaaccugaagaucuucagcaacaugaccaacaagugcggcaccugcaucugcggcuucaaccaggagaucagaagcggcuucgacuacgagguguucaucaaggacaugcacgugagcagagagagcugcaaguacaacuaccacaagaacuacagcuucuacaucaagaugcugcugguggugcugcuggugccccugaucggcaccaccgccgccgaggacaccaagugccugaaguacgaccugaacaagaacaucgaggaccugaaggacugcuacggccugaagcugaacaucgacaagcacgacaccguggagaacgccuacaagaaccugguggaccagaagcuggugagcgagcuggacagacuggaccugaacaucaugcugggcagcaaggagagcaucuucgaggccaucgagaccagcaugaacauccaccagaugguguuccuggaguaccuggccuacaagaccgaccccaagcugagcgagaucaagcagaacaccggccccuacaacaucgccuggagaaccuucauccacggcaacagccuggaggugugcggcaacuaccccuacaagcugaucugcuacugcaucaagcagaagacccacugcgagaacagcaccguggacuacggcauccagauccagcccuucuacaaccagcaccccaacagcuacaagagcgacauggaggcccugaucaagaccgugcagaucgccuucagaggcaucaucaaggugcugauccaguacuacguggagaacaacaagaccagcgagcugagcaaccugcugaccgagcugagaaacgugaugggcaacaacauccagaugaagggcauccugaaguaccuggagaccuaccugaagaagccccugcugauggccagaaccaucagaaucgccgccaagguggacaccagcggcgaccccuacaacaacuucagcaccagcaaggagaacaucaccaagugcaucaagauccagaagcugagaugcaucaccaagcugaccagaaucgagcacaacuacauccugugcggcgacagcgagaagaagcuguaccaguggcccgccaagcccaccaucguggacgacaacgacgccugccugggcgacaagcacugccaccugcccuucauccccaucggcaacgacgaggccaucaagaccgugaacugcuacguggagguguacgagcagaaccccggcgacaugaacagcuaccagaagaagugcgacgccaugaacgugggcaccugccugaccaucaagaacgagaacuggcccaucgugcagugcaagaccggcaaguacuacuacgccgacggcagaauccacgccaaggacggcaccaucaacaccuacugcuucagcgagaagugcaacgccgacagauaccccauccaccaggacuacaucaacagcugcaacuggcaggagaccaucaaggacuuccagcacgugagagaguucgugcaccuggacaucgagagcuacaagaaggccaucgagagcgacaucaagaccgaccugguggugcacaaguucagacccgugaagaaccugccccacgugauccccaucuacaagagcaucaccgugcagggcaccgagaccagcgacggcauccagaacgccuucauccagggcagcaugcccgccaucagcggccuggccaacggcuaccaccuguucacccccgacagcaagcagcuguucgacguggugcuguuccugagaaaggccagcuacaaggccgaguacagaaagaucuacagcaccggccccaccaucggcaucaacguggagcacaacgagaagugcaccggcagcugccccaagaccaucgacaagaaggacaacuggcugaccuucagcaaggagcacaccagccaguggggcugcgaggaguacggcugccuggccaucaacaccggcugcguguucggcagcugccaggacaucaucagacccgagaucgacguguacaagaugcacggcgccgagagaagcgugguggagcugugcaucacccugccccacgagaccuacugcaacgaccuggacgugcuggagcccaucaucggcgacaagauccaggccgccuuccagaccgugcagagcaaccacaugcccagacugauggccaucaagaacaacaaggccuucaccggccagaucaacgaccugggcagcaccgccagcuacugcggcagcgugcagaaguucaacgagaccaucaucggccagggcgaccccaaguucgacuacgugugccaccugcugaagagaaaggacaucaucgugagaagaugcuacagcaacaacuacgagagcugcaagcugcugacccccagagccgacaucaucguggacaagaagggcgagagccugcaggccagcaucgugggccugaaccugggccagaugaacuucaagaucaugcugggcgacaucaacuacaagcaguacaccgagagcaacaaccuggaggccaccggccagugcgugggcugcguggacugcagcgaggacaucgugugcaaccugaagaucgagagccagagcgagagcgugugcaacaucaagagcgacugcaaccuguaccugagcagcaugcugauccagcccaccgugggcgaguacaaccugaagaugagcugcaacgccaagcuggacaaggugaacaucgagaucugcaagcagaaguucgugcugccccugaccaucaagagccacaaccagaagaucgaccugagcaagcuggacgagagcaacuacaucagagaggaggaccugaagugcgacaccaugaucugcaaggugaaggacgagggccugagcuucaucaccaacagccuguucggcggcaucagcuacuucuggaagauccugaucagcagccugaucgugaucuuccugaucauccuguucuacuacgugggccugcccauccugagacugaucaaggacuaccugaaggagaacgagcuggaguaccuggccgagggcaaguga

SEQ ID NO: 9424 - RNA, 4284 nt, Artificial Sequence
  derived and/or modified CDS sequence (opt4) from OROV/UTIV(BeAn84785)__KF697155.1__GP
auguuccugaucuucauccugauccagaucgccgccagcaccccccugagcccccagcaggugggcgacagaugcuucaucggcggcagccugaucaaggagaucaaccagagcaccggccugggcgaggugugcaucaaggacgacaucagcaucaucaagagcaucaacauccagaagaagaucagcaacgaccaggugcagaacaccgugaaguucuacaagaccuacaucgccagagaguggcacgacugcaaccccaucuucgacgagcacggcagcuucaugguguucgacaucagcaacaccggcagcaucauccccaagaugcacaccugcagagcccagugcgagaucacccugaacaaggacaacgccgaggugaucuucaccagcgccaagaccaaccacuacgaggugagcggcaccaccaccgugaacggcugguucaagcagaccaucagcgugagccuggagcacaccugcgagcacaucaucgccagcugcggccagaagagccugaaguuccacgccugcuucagacagcacagaagcugcgugagauucuucagaaacagcuaccugcccuacaagaugaucgagagccugugcaucaacaucgagcugaucaucauccugugcuacgcccugcugugcuucaucuucgccuacaucaucaccaagaccuacaucgccuaccugcugaucccccuguucuaccccaucaccuacaucuacggcaagaucuacaacaaguacuucaagagaugcaagagcugccugcuggccgugcacccccugaccaacugcaacaagaccugcgugugcggcugcagauucaacagcaccgaggcccugaaggugcacagacugggcaaggacugcaacggcuucaaggcccugagcaaggccagauuccugugcaagagcaccggccccagcuucaccaucugcuuccugaccggcaugcugauccugagcuucaucacccccaucaacagcgagaagcuguacaagcuggaggagcugcccgacgacuacaucaaccuggagaaccagcugagcgagugcaacaacaacaagcagaucaccagagcccuggccguggccugcauccugggcaacauccuguucgugcuguucuucaaguucaucuacaacaagcugaucaacaacaucuacagaaccugcaaccugugcaacauggugcaccacagaaagaaccugaagaucuacagcgaguucaccaacaagugcggcaccugcgugugcggcuucaacgaggagaucagaagcggcuucgacuacgagguguucaucaaggacaugcacaucuucagagacaacugccuguucaaguucuacagcaaguacagcaucaucuacaucugcaucaucauccuggugaucaaccugcagcugggcaugacccuggccgaggagaccgagaccaacugccugaaccugcccaucagcgcccagacccuggacaucgugaagugcuacggccugaaccugaacaucaccgagaacaagcagaagagcgaccugaucagcgagcugaagagccagaagaccaucaccgaccacgacauccccgacuucaacaucaucgacaugaagaccgagagcgccuucgagaagaucgagaccgccgagaacauccacagaauggccuuccuggaguacauccuguacaagauggagagcaagcugaacaccaucaagaccaacagcggccccuacaacguggccuggagaaccuacaucaaguaccacaaccuggacgccugcggcaaguacccccacaagaccaucugcaccugcaucaacgcccaccugagcugcagccagcccaccguggacagcaacagcgagaucaagaccuucuacagcaaccaccagagcgccuucaagaacgacaucaacgugcugaucgagaccaucagcaucgccuucagaggcaucaucaaggugagcaucaaccugcugcugaagaacaacaagaucgacgagcugaaggagcugcugaccaacaucagcaagaagcuggacaccaacauccagaugaagggcauccugcuguucaccgccgagcagcugaagacccaggagaccaccgugaagagcaugcagcagaccagaauggccaucaucgugaagccccuggagagcaugaccggcgacaaguucgacaacuucagcaccaccaacagaaacaucaccaagugcaaggaggccaagagccugagcugcuacaugaccagaaagaacagcaucaacaaguaccugcugugcaaccuggacggcuacaagaucuucagcuggcccgagaagcccacccugagcaucaacaacaacaucugcaucggcgacagccacugcaaccuguacuucaagcccauccugaacgacgaggccaucaagaccaucaacugcuacaagggcgacuucacccccaaccccauggacaugggcagcgccaucaagaagugcgaggccaaggagaucggcgacugccuggugggcgacaacaacauguggcccaucauccagugcagcaacgagaaguacuacuacgccgacggcaagaaccacgccaaggagggcgacaucaacagcuacugccugagcgagaagugcaacaccgacagauuccccauccacaacgagugguucaagagcugcaaguggaucagcaccaucaaggagagcaucagcgugaaggaguucgugcaccuggacaucgagagcuacaagaagggcaucgagagcgacaucagaaccgaccugaucauccacaaguucagacccgugaagaaccugccccacaucgcccccaaguacaagagcaucaccaucagcggcauccugguggccgacggcauccagaacgccuucgugagcggcgagaugcccgccaucagcggccugggcaucggcuacaaccuguacagccccgacggcaccaagcuguucgacaucgugcuguuccugagaaaggccaucuacaagagcagcuacaagcugaucuacaagaccggccccaccaucggcaucaacguggagcacaacgagcagugcaccggcagcugccccagcaccauccccaagcaggagggcuggcugaccuucagcaaggagcacaccagccaguggggcugcgaggaguucggcugccuggccaucgacaccggcugccuguacggcagcugccaggacaucaucagacccgagaugagcaucuacaagaugcugggcgaggagaugaccagcaucgagaucugccugaccacccccaaggagaccuacugcaacgaccuggaccugcuggagccccugaucggcgacaagaucgaggugagcuuccagaccgugcagagcagccacaugcccaagaucaucgccgugaagaacaacaagguguacaccggccagaucaacgacaucggcaacaccgccaacaucugcggcagcgugcagaucaucaacaagaccgugaucggccagggcaaccccaaguucgacuaccugugccacgccaugaagagaaaggacgugaucgugagaaagugcuacgacaaccacuucgagaccugcaagcugcuggaggagagaagcgagauccugaucaaccagcagagcgacaccaucgccgccagcaugagcggcaagaaccugggcaucaugaacuucaaguucgcccugggcgacaucgacuacaagaccuucaccgaggacgccagcuucgacaucaagggccagugcgugggcugcaucaacugcaucgaggagaucgugugcgagcugaacaucgugagcaccagcagcauccugugcaccaucaagacccccugcgagaacuaccacaacagccuggagaucaaccccgccaccaccaaguaccacaucaagaugagcugcccccacaacaucgacaagaugaagaucaccaucugcagcaaggaccuggagaugccccugacccugaagcagcacgaccagaagaucgaccugagcaagcuggacgagagcaacuacaucaaggaggaggaccugagaugcagcaccuggcugugcaaggugaaggaggagggcaucggcuucaucuucagcggcaucuucggcaacuucggcaaguacuggaccaucuuccugaucgugcuggugauccuggccaccggccugcugggcaucuucgugaucuaccccugcugcaagagacugagaggcuuccuggagaucaacgacaucgccuaccuggccgagcagaagaugaaguga

SEQ ID NO: 9425 - RNA, 3231 nt, Artificial Sequence
  derived and/or modified CDS sequence (opt4) from HRTV(TN)__KJ740147.1__GP
augaucgugcccaucgugcuguuccugacccugugccccagcgagcugagcgccuggggcagccccggcgaccccaucgugugcggcgugagaaccgagaccaacaagagcauccagaucgaguggaaggagggcagaagcgagaagcugugccagaucgacagacugggccacgugaccagcuggcugagaaaccacagcagcuuccagggccuggugggccaggugaagggcagacccagcgugagcuacuuccccgagggcgccagcuaccccagauggagcggccugcugagccccugcgacgccgaguggcugggcaugaucgccgugagcaaggccggcgacaccgacaugaucgugcccggccccaccuacaagggcaagaucuucguggagagacccaccuacaacggcuacaagggcuggggcugcgccgacggcaagagccugagccacagcggcaccuacugcgagaccgacagcagcgugagcagcggccugauccagggcgacagagugcugugggugggcgagguggugugccagagaggcacccccgugcccgaggacguguucagcgagcuggugagccugagccagagcgaguuccccgacgugugcaagaucgacggcguggcccugaaccagugcgagcaggagagcaucccccagccccuggacguggccuggaucgacgugggcagaagccacaaggugcugaugagagagcacaagaccaagugggugcaggagagcagcgccaaggacuucgugugcuucaaggugggccagggccccugcagcaagcaggaggaggacgacugcaugagcaagggcaacugccacggcgacgagguguucugcagaauggccggcugcagcgccagaaugcaggacaaccaggagggcugcagaugcgagcugcugcagaagcccggcgagaucaucgugaacuacggcggcgugagcgugagacccaccugcuacggcuucagcagaaugauggccacccuggaggugcacaagcccgacagagagcugaccggcugcaccggcugccaccuggagugcaucgagggcggcgugaagaucgugacccugaccagcgagcugagaagcgccaccgugugcgccagccacuucugcgccagcgccaagggcggcagcaagaccaccgacauccuguuccacaccggcgcccuggugggccccaacagcaucagaaucaccggccagcugcuggacggcagcaaguucagcuucgacggccacugcaucuuccccgacggcugcauggcccuggacugcaccuucugcaaggaguuccugagaaacccccagugcuaccccgugaagaaguggcuguuccuggugguggugaucaugugcugcuacugcgcccugaugcugcugaccaacauccugagagccaucggcguguggggcaccuggguguucgcccccaucaagcuggcccuggcccugggccugagacuggccaagcugagcaagaagggccugguggccguggugaccagaggccagaugaucgugaacgacgagcugcaccagaucagaguggagagaggcgagcagaacgagggcagacagggcuacggccccagaggccccaucagacacuggcuguacagccccgcccugauccugauccugaccaccagcaucugcagcggcugcgacgagcuggugcacgccgagagcaagagcaucaccugcaagagcgccagcggcaacgagaaggagugcagcgugaccggcagagcccugcugcccgccgugaaccccggccaggaggccugccugcacuucagcaugcccggcagccccgacagcaagugccugaagaucaaggugaagagcaucaaccugagaugcaagcaggccagcagcuacuacgugcccgaggccaaggccagaugcaccagcgugagaagaugcagaugggccggcgacugccagagcggcugccccaccuacuucagcagcaacagcuucagcgacgacugggccaacagaauggacagagccggccugggcaugagcggcugcagcgacggcugcggcggcgccgccugcggcugcuucaacgccgcccccagcugcaucuucuggagaaaguggguggagaaccccagcaacagaguguggaaggugagccccugcgccagcugggugcuggccgccaccaucgagcugacccugcccagcggcgaggugaagacccuggagcccgugaccggccaggccacccagauguucaagggcguggccaucaccuaccugggcagcagcaucgagaucgugggcaugaccagacugugcgagaugaaggagaugggcaccggcaucauggcccuggcccccugcaacgaccccggccacgccaucaugggcaacgugggcgagauccagugcagcagcaucgagagcgccaagcacaucagaagcgacggcugcaucuggaacgccgaccuggugggcaucgagcugagaguggacgacgccgugugcuucagcaagcugaccagcguggaggccguggccaacuucagcaagauccccgccaccaucagcggcgugagauucgaccagggcaaccacggcgagagcagaaucuacggcagcccccuggacaucaccagagugagcggcgaguucagcgugagcuucagaggcaugagacugaagcugagcgagaucagcgccagcugcaccggcgagaucaccaacgugagcggcugcuacagcugcaugaccggcgccagcgugagcaucaagcugcacagcagcaagaacaccaccggccaccugaagugcgacagcgacgagaccgccuucagcgugauggagggcacccacaccuacagaccccacaugagcuucgacaaggccgugaucgacgaggagugcgugcugaacugcggcggccacagcagcaagcugcugcugaagggcagccugguguucauggacgugcccagauucguggacggcagcuacgugcagaccuaccacagcaaggugcccgccggcggcagagugcccaaccccguggacuggcugaacgcccuguucggcgacggcaucaccagauggauccugggcaucaucggcgugcugcuggccugcgugaugcuguucgugguggugguggccaucaccagaagacugaucaagggccugacccagagagccaagguggccuga

SEQ ID NO: 9426 - RNA, 3231 nt, Artificial Sequence
  derived and/or modified CDS sequence (opt4) from HRTV(Patient2)__JX005844.1__GP
augaucgugcccaucgugcuguuccugacccugugccccagcgagcugagcgccuggggcagccccggcgaccccaucgugugcggcgugagaaccgagaccaacaagagcauccagaucgaguggaaggagggcagaagcgagaagcugugccagaucgacagacugggccacgugaccagcuggcugagaaaccacagcagcuuccagggccugaucggccaggugaagggcagacccagcgugagcuacuuccccgagggcgccagcuaccccagauggagcggccugcugagccccugcgacgccgaguggcugggccugaucgccgugagcaaggccggcgacaccgacaugaucgugcccggccccaccuacaagggcaagaucuucguggagagacccaccuacaacggcuacaagggcuggggcugcgccgacggcaagagccugagccacagcggcaccuacugcgagaccgacagcagcgugagcagcggccugauccagggcgacagagugcugugggugggcgagguggugugccagagaggcacccccgugcccgaggacguguucagcgagcuggugagccugagccagagcgaguuccccgacgugugcaagaucgacggcguggcccugaaccagugcgagcaggagagcaucccccagccccuggacguggccuggaucgacgugggcagaagccacaaggugcugaugagagagcacaagaccaagugggugcaggagagcagcgccaaggacuucgugugcuucaaggugggccagggccccugcagcaagcaggaggaggacgacugcaugagcaagggcaacugccacggcgacgagguguucugcagaauggccggcugcagcgccagaaugcaggacaaccaggagggcugcagaugcgagcugcugcagaagcccggcgagaucaucgugaacuacggcggcgugagcgugagacccaccugcuacggcuucagcagaaugauggccacccuggaggugcacaagcccgacagagagcugaccggcugcaccggcugccaccuggagugcaucgagggcggcgugaagaucgugacccugaccagcgagcugagaagcgccaccgugugcgccagccacuucugcgccagcgccaagggcggcagcaagaccaccgacauccuguuccacaccggcgcccuggugggccccaacagcaucagaaucaccggccagcugcuggacggcagcaaguucagcuucgacggccacugcaucuuccccgacggcugcauggcccuggacugcaccuucugcaaggaguuccugagaaacccccagugcuaccccgugaagaaguggcuguuccuggugguggugaucaugugcugcuacugcgcccugaugcugcugaccaacauccugagagccaucggcguguggggcaccuggguguucgcccccaucaagcuggcccuggcccugggccugagacuggccaagcugagcaagaagggccugguggccguggugaccagaggccagaugaucgugaacgacgagcugcaccaggugagaguggagagaggcgagcagaacgagggcagacagggcuacggccccagaggccccaucagacacuggcuguacagccccgcccugauccugauccugaccaccagcaucugcagcggcugcgacgagcuggugcacgccgagagcaagagcaucaccugcaagagcgccagcggcaacgagaaggagugcagcgugaccggcagagcccugcugcccgccgugaaccccggccaggaggccugccugcacuucagcgugcccggcagccccgacagcaagugccugaagaucaaggugaagagcaucaaccugagaugcaagcaggccagcagcuacuacgugcccgaggccaaggccagaugcaccagcgugagaagaugcagaugggccggcgacugccagagcggcugccccaccuacuucagcagcaacagcuucagcgacgacugggccaacagaauggacagagccggccugggcaugagcggcugcagcgacggcugcggcggcgccgccugcggcugcuucaacgccgcccccagcugcaucuucuggagaaaguggguggagaaccccagcaacagaguguggaaggugagccccugcgccagcugggugcuggccgccaccaucgagcugacccugcccagcggcgaggugaagacccuggagcccgugaccggccaggccacccagauguucaagggcguggccaucaccuaccugggcagcagcaucgagaucgugggcaugaccagacugugcgagaugaaggagaugggcaccggcaucauggcccuggcccccugcaacgaccccggccacgccaucaugggcaacgugggcgagauccagugcagcagcaucgagagcgccaagcacaucagaagcgacggcugcaucuggaacgccgaccuggugggcaucgagcugagaguggacgacgccgugugcuucagcaagcugaccagcguggaggccguggccaacuucagcaagauccccgccaccaucagcggcgugagauucgaccagggcaaccacggcgagagcagaaucuacggcagcccccuggacaucaccagagugagcggcgaguucagcgugagcuucagaggcaugagacugaagcugagcgagaucagcgccagcugcaccggcgagaucaccaacgugagcggcugcuacagcugcaugaccggcgccagcgugagcaucaagcugcacagcagcaagaacaccaccggccaccugaagugcgacagcgacgagaccgccuucagcgugauggagggcacccacaccuacagaccccacaugagcuucgacaaggccgugaucgacgaggagugcgugcugaacugcggcggccacagcagcaagcugcugcugaagggcagccugguguucauggacgugcccagauucguggacggcagcuacgugcagaccuaccacagcaaggugcccgccggcggcagagugcccaaccccguggacuggcugaacgcccuguucggcgacggcaucaccagauggauccugggcaucaucggcgugcugcuggccugcgugaugcuguucgugguggugguggccaucaccagaagacugaucaagggccugacccagagagccaagguggccuga

SEQ ID NO: 9427 - RNA, 3231 nt, Artificial Sequence
  derived and/or modified CDS sequence (opt4) from HRTV(Patient1)__JX005845.1__GP
augaucgcccccguggugcuguucuucacccugugccccagccagcugagcgccuggggcagccccggcgaccccaucgugugcggcgugagaaccgagaccaacaagagcauccagaucgaguggaaggagggcagaagcgagaagcugugccagaucgacagacugggccacgugaccagcuggcugagaaaccacagcagcuuccagggccugaucggccaggugaagggcagacccagcgugagcuacuuccccgagggcgccagcuaccccagauggagcggccugcugagccccugcgacgccgaguggcugggccugaucgccgugagcaaggccggcgacaccgacaugaucgugcccggccccaccuacaagggcaagaucuucguggagagacccaccuacaacggcuacaagggcuggggcugcgccgacggcaagagccugagccacagcggcaccuacugcgagaccgacagcagcgugagcagcggccugauccagggcgacagagugcugugggugggcgagguggugugccagagaggcacccccgugcccgaggacguguucagcgagcugaucagccugagccagagcgaguuccccgacgugugcaagguggacggcguggcccugaaccagugcgagcaggagagcaucccccagccccuggacguggccuggaucgacgugggcagaagccacaaggugcugaugagagagcacaagaccaagugggugcaggagagcagcgccaaggacuucgugugcuucaaggugggccagggccccugcagcaagcaggaggaggacgacugcaugagcaagggcaacugccacggcgacgagguguucugcagaauggccggcugcagcgccagaaugcaggacaaccaggagggcugcagaugcgagcugcugcagaagcccggcgagaucaucgugaacuacggcggcgugagcgugagacccaccugcuacggcuucagcagaaugauggccacccuggaggugcacaagcccgacagagagcugaccggcugcaccggcugccaccuggagugcaucgagggcggcgugaagaucgugacccugaccagcgagcugagaagcgccaccgugugcgccagccacuucugcgccagcgccaagggcggcagcaagaccaccgacauccuguuccacaccggcgcccuggugggccccaagagcaucagaaucaccggccagcugcuggacggcagcaaguucagcuucgacggccacugcaucuuccccgacggcugcauggcccuggacugcaccuucugcaaggaguuccugagaaacccccagugcuaccccgugaagaaguggcuguuccugguggugguggugaugugcugcuacugcgcccugaugcugcugaccaacauccugagagccaucggcguguggggcaccuggguguucgcccccaucaagcuggugcuggcccugggccugagacuggccaagcugagcaagaagggccugguggccguggugaccagaggccagaugaucgugaacgacgagcugcaccagaucagaguggagagaggcgagcagaacgagggcagacugggccacggccccagaggccccgugagacacuggcuguacagccccgcccugauccugauccugaccaccagcaucugcagcggcugcgacgagcuggugcacgccgagagcaagagcaucaccugcaagagcgccagcggcaacgagaaggagugcagcgugaccggcagagcccugcugcccgccgugaaccccggccaggaggccugccugcacuucagcaugcccggcagccccgacagcaagugccugaagaucaaggugaagagcaucaaccugagaugcaagcaggccagcagcuacuacgugcccgaggccaaggccagaugcaccagcgugagaagaugcagaugggccggcgacugccagagcggcugccccaccuacuucagcagcaacagcuucagcgacgacugggccaacagaauggacagagccggccugggcaugagcggcugcagcgacggcugcggcggcgccgccugcggcugcuucaacgccgcccccagcugcaucuucuggagaaaguggguggagaaccccagcaacagaguguggaaggugagccccugcgccagcugggugcuggccgccaucaucgagcugacccugcccagcggcgaggugaagacccuggagcccgugaccggccaggccacccagauguucaagggcguggccaucaccuaccugggcagcagcaucgagaucgugggcaugaccagacugugcgagaugaaggagaugggcaccggcaucauggcccuggcccccugcaacgaccccggccacgccaucaugggcaacgugggcgagauccagugcagcagcaucgagagcgccaagcacaucagaagcgacggcugcaucuggaacgccgaccuggugggcaucgagcugagaguggacgacgccgugugcuucagcaagcugaccagcguggaggccguggccaacuucagcaagauccccgccaucaucagcggcgugagauucgaccagggcaaccacggcgagagcagaaucuacggcagcccccuggacaucaccaaggugagcggcgaguucagcgugagcuucagaggcaugagacugaagcugagcgagaucagcgccagcugcaccggcgagaucaccaacgugagcggcugcuacagcugcaugaccggcgccagcgugagcaucaagcugcacagcagcaagaacaccaccggccaccugaagugcgacagcgacgagaccgccuucagcgugauggagggcacccacaccuacagaccccacaugagcuucgacaaggccgugguggacgaggagugcgugcugaacugcggcggccacagcagcaagcugcugcugaagggcagccugguguucauggacgugcccagauucguggacggcagcuacgugcagaccuaccacagcaaggugcccgccggcggcagagugcccaaccccguggacuggcugaacgcccuguucggcgacggcaucaccagauggauccugggcaucaucggcgugcugcuggccugcgugcugcuguucgugguggugguggccaucaccagaagacugaucaagggccugacccagagagccaagguggccuga

SEQ ID NO: 9428 - RNA, 3942 nt, Artificial Sequence
  derived and/or modified CDS sequence (opt4) from PTV(PAN472868)__NC_027201.1__GP
augaucuucaccauccugaacgugcugaccagagccaugcuggugaugagcauguacagccugaccaccugggacagcaccagcagaaacgacaugugcuucagcaacgacagcccccuggagggccugguguacuacugggagacccacagcaagaagcacgacuacaagaagcaggagagccagagaugcagagugggcgacagcgacaagaagaugaucaccaacgugaccaucaucagccugaucagcgagauccagaagagcaucagcgagcugagccugagcugcggcaacgacgacaacagcaccggccaggugcugaccuucaacggccuggaggacaccauccagggcgacuacaucguggacugcgugaccggccuguaccagagcgacaucggcgugggcgugggccugggcaagacccaccacgaccaccagcaggugaagaacaaggccguggugaucgacgagaaggagagaaugaucagcuuccuggagacccagcagagcgagaacgacaucaagaugcaggugcugaugagcgagaucgagcagcugaagaaccagcugagcaagaagagaaacgagagaggccaggagaagagagacgccgagaaggugaugagcgaccugauggccagaaacagcgaccugagaaagcacaacgacauccugaccgccgagaucagccagauggagaacaacaacaccauccagagaaacaagaacgugaugagcaccaccguggugcccgccauccugagcguggcccugcugagcagcagcaucgcccccaucauggccgccagccccgacagccccaugaucaaccccuggccccacgccaagaacagagugggcaccggcauguacaaguacgacgagaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcauccaggugcagaagaccagcgugccccugcaggacgccaucugccaggagaacagcgacaccuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacaacagcaagcagaagaucugcaccggcgaccacaucuucugcgagaaguacgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucgugcccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacaugcuguacgugcugagacugauccccaagcagcugaagagccccgugggcuggcugagacuguucaucaacuggcugcugaccgcccugagaaucaagaccagaaacgugaugggcagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcagcaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacaaggugagaagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucauccuguucaugauccugaucagaaucgccgugaacagcaucaacaucaagaagaagaacuga

SEQ ID NO: 9429 - RNA, 3942 nt, Artificial Sequence
  derived and/or modified CDS sequence (opt4) from PTV(Adames)__KR912209.1__GP
augaucuucaccauccugaacgugcugaccagagccaugcuggugaugagcauguacagccugaccaccugggacagcagcagcagaaacgacaucugcuucagcaacgacagcccccuggagggccugguguacuacugggagacccacagcaagaagcacgacuacaagaagcagggcagccagaagugcagagugggcgacagcgacaagaagaugaucagcaacgugaccaucaucagccugaucagcgagauccagaagagcaucagcgagcugagccugagcugcggcaacaacgacaacagcaccggccaggugcugaccuucaacggccuggaggacaccaucagaggcgacuacaucguggacugcgugaccggccuguaccagagcgacaucggcgugggcgugggccugggcagaaucaaccacgaccaccagcaggugaagaacaaggccguggugaucgacgagaaggagaagaugaucagccugcuggagacccagcagagcgagaacgacaucaagacccaggugcugaugagcgagaucgagcagcugaagaaccagcugagcaagagaagaaacgagagaggccaggagaagagagacgccgagaagcugaugagcgaccugauggccagaaacagcgaccugagaaaccacaacgugauccugaccgacgagaucagccagaucaagaacaacaucaccauccacagaaacagaaacaugaugagcaccaccguggugcccgccauccugagcguggcccugcugagcagcagcgugggccccaucaccgccgccccccccgacagcaccaugaucaaccccuggccccacgccaagaacagagugggcaccggcauguacaaguacgacgagaacgacgagagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaucuacagcggccccaagauccccuucaagggcgugugcaagaucggccugaucaaguacaaggagugcaaguucaagaccagcagcuacgagaccaucagcuucaucacccugaagggcaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacaacagcaagcagaagaucugcaccggcgaccacaucuucugcgagaaguacgacugcagcaccagcuaccccgacgugaccugcauccacacccccggcagcggcccccuguacaucaaccugaugggcagcuggaucaagccccagugcgugggcuacgagagagugcugguggacagagaggugaagcagccccugcuggugcccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucauccccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccgccuucagcgugaccaccaacgugcuguacgugcugagacugauccccaagcagcugaagagccccgugggcuggcugaagcuguucgugaacuggcugcugaccgcccugagaaucaagaccagaagagugaugggcagaaucaaccagagaaucggcuggguggaccaccacgacguggagagacccagacacagagagcccaugagaagauucaagaccacccugcugcugacccugaucauggugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagauggagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucaucuucaucaacaaggugaagagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcaccagagacuacugccaggugcugcacuuccagaagccccugguggacgagagacugagcuacagcugcggcagcgagcccaagcugaucgugaucaagggcacccugguguacaugggcguguacgacuucagagacaagaccggcggcagcagcaccgugaucaaccccagcgagggcaccuggagcaucagcaacugguucagcggccugcuggacuggcugggcggccccaugaaggccauccugaagauccugggcuucaucgccaucggcaucgugugcuucauccuguucaugauccugaucagaaucgccgugaacagcaucaacaucaagaagaagaacuga

SEQ ID NO: 9430 - RNA, 3942 nt, Artificial Sequence
  derived and/or modified CDS sequence (opt4) from PTV(Balliet)__KR912213.1__GP
augaucuucaccauccugaacgugcugaccagagccaugcuggugaugagcauguacagccugaccaccugggacagcaccagcagaaacgacaugugcuucagcaacgacagcccccuggagggccugguguacuacugggagacccacagcaagaagcacgacuacaagaagcaggagagccagagaugcagagugggcgacagcgacaagaagaugaucaccaacgugaccaucaucagccugaucagcgagauccagaagagcaucagcgagcugagccugagcugcggcaacgacgacaacagcaccggccaggugcugaccuucaacggccuggaggacaccaucagaggcgacuacaucguggacugcgugaccggccuguaccagagcgacaucggcgugggcgugggccugggcagaacccaccacggccaccagcagaugaagaacaaggccguggugaucgacgagaaggagagaaugaucagccugcuggagacccagcagagcgagaacgacaucaagaugcaggugcugaugagcgagaucgagcagcugaagaaccagcugagcaagaagagaaacgagagaggccaggagaagagagacgccgagaaggugaugagcgaccugauggccagaaacagcgaccugagaaagcacaacgacauccugaccgccgagaucagccagaugaagaacaagaacaccauccagagaaacaagaacaccgugagcaccaccguggugcccgccauccugagcguggcccugcugagcagcagcguggcccccaucaucgccgccccccccgacagccccaugaucaaccccuggccccacgccaagaacagagugggcaccggcauguacaaguacgacgagaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaccuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgugggccaggacgagcaggagguggagcacagagcccugaagagagugagcgugaacgacugcaagaucguggacaacagcaagcagaagaucugcaccggcgaccacguguucugcgagaaguacgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggagcccagcaccagcgugaucgugcccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacauccuguacgugcugagacugauccccaagcagcugaagagccccgugggcuggcugaagcuguucaucaacuggcugcugaccgcccugagaaucaagaccagaaacgugaugagaagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacaacgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacaaggugaagaacugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucgugcuguucaugauccugaucagaaucgccgugaacagcaucaacaucaagaagaagaacuga

SEQ ID NO: 9431 - RNA, 3942 nt, Artificial Sequence
  derived and/or modified CDS sequence (opt4) from PTV(PaAR2381)__KP272005.1__GP
augaucuucaccauccugaacauccugaccagagccaugcuggugaugagcauguacagccugaccaccugggacagcaccagcagaaacgacaugugcuucagcaacgacagcccccuggagggccugguguacuacugggagacccacagcaagaagcacgacuacaagaagcaggagagccagaagugcagagugggcgacagcgacaagaagaugaucagcaacgugaccaucaucagccugaucagcgagauccagaagagcaucagcgagcugagccugagcugcggcaacgacgacaacagcaccggccaggugcugaccuucaacggccuggaggacaccaucagaggcgacuacaucguggacugcgugaccggccuguaccagagcgacaucggcgugggcgugggccugggcagaacccaccacgaccaccaccaggugaagaacaaggccguggugaucgacgagaaggagagaaugaucagccugcuggagacccagcagagcgagaacgacaucaagaugcaggugcugaugagcgagaucgagcagcugaagaaccagcugagcagaaagagaaacgagagaggccaggagaagagagacgccgagaaggugaugagcgaccugauggccagaaacagcgaccugagaaagcacaacgacauccugaccgccgagaucagccagaugaaguacaacaacaccauccagagaagcaagaacgugaugagcaccaccguggugcccgccauccugagcguggcccugcugagcagcagcguggcccccaucauggccgccccccccgacagccccaugaucaaccccuggccccacgccaagaacagagugggcaccggcauguacaaguacgacgacaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaacuacagcggccccaagauccccuucaagggcgugugcagaaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacaacagcaagcagaagaucugcaccggcgaccacguguucugcgagaaguacgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucgugcccuaccccggccugcuggccagcgugggcggcagaaucggcauccaccugagccacaccagcgacagcgccagcgugcacauggugguggugugcccccccagagacagcugcgaggcccacaacugccugcugugcuaccacggcauccugaacuaccagugccacagcacccugagcgccauccugaccagcuuccugcugauccuguucaucuacaccguguucagcgugaccaccaacaugcuguacgugcugagacugauccccaagcagcugaagagccccgugggcuggcugaagcuguucaucaacuggcugcugaccgcccugagaaucaagaccagaaacgugaugggcagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacaaggugaagagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucauccuguucaugaucaugaucagaaucgccgugaacagcaucaacaucaagaagaagaacuga

SEQ ID NO: 9432 - RNA, 3942 nt, Artificial Sequence
  derived and/or modified CDS sequence (opt4) from PTV(PAN483391)__KP272008.1__GP
augaucuucaccauccugaacauccugaccagagccaugcuggugaugagcauguacagccugaccaccugggacagcaccagcagaaacgacaugugcuucagcaacgacagcccccuggagggccugguguacuacugggagacccacagcaagaagcacgacuacaagaagcaggagagccagagaugcagagugggcgacagcgacaagaagaugaucaccaacgugaccaucaucagccugaucagcgagauccagaagagcaucagcgagcugagccugagcugcggcaacgacgacaacagcaccggccaggugcugaccuucaacggccuggaggacaccaucagaggcgacuacaucguggacugcgugaccggccuguaccagagcgacaucggcgugggcgugggccugggcagaacccaccacgaccaccagcaggugaagaacaaggccguggugaucgacgagaaggagagaaugaucagccugcuggagacccagcagagcgagaacgacaucaagaugcaggugcugaugagcgagaucgagcagcugaagaaccagcugagcaagaagagaaacgagagaggccaggagaagagagacgccgagaaggugaugagcgaccugauggccagaaacagcgaccugagaaagcacaacgacauccugaccgccgagaucagccagaugaaguacgacaacaccauccagagaaacaagaacgugaugagcaccaccguggugcccgccauccugagcguggcccugcugagcagcagcaucgcccccaucauggccgccagccccgacagccccaugaucaaccccuggccccacgccaagaacagagugggcaccggcauguacaaguacgacgagaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaccuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacaacagcaagcagaagaucugcaccggcgaccacguguucugcgagaaguacgacugcagcaccagcuaccccgacgugaccugcauccacgcccccggcagcggcccccuguacaucaaccugaugggcagcuggaucaagccccagugcgugggcuacgagaaggugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucgugcccuaccccggccugcuggccagcgugggcggcaagaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacaugcuguacgugcugagacugauccccaagcagcugaagagccccgugggcuggcugagacuguucaucaacuggcugcugaccgcccugagaaucaagaccagaaacgugaugggcagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcaacaccaagugcagcaucaccgccaccaucacccugaaggccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacaaggugagaagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucauccuguucaugauccugaucagaaucgccgugaacagcaucaacaucaagaagaagaacuga

SEQ ID NO: 9433 - RNA, 3942 nt, Artificial Sequence
  derived and/or modified CDS sequence (opt4) from PTV(GML902876)__KP272011.1__GP
augaucuucaccauccugaacgugcugaccagagccaugcuggugaugagcauguacagccugaccaccugggacagcaccagcagaaacgacaugugcuucagcaacgacagcccccuggagggccugguguacuacugggagacccacagcaagaagcacgacuacaagaagcaggagagccagaagugcagagugggcgacagcgacaagaagaugaucagcaacgugaccaucaucagccugaucagcgagauccagaagagcaucagcgagcugagccugagcugcggcaacgacgacaacagcaccggccaggugcugaccuucaacggccuggaggacaccaucagaggcgacuacaucguggacugcgugaccggccuguaccagagcgacaucggcgugggcgugggccugggcagaacccaccacgaccaccaccaggugaagaacaaggccguggugaucgacgagaaggagagaaugaucagccugcuggagacccagcagagcgagaacgacaucaagaugcaggugcugaugagcgagaucgagcagcugaagaaccagcugagcagaaagagaaacgagagaggccaggagaagagagacgccgagaaggugaugagcgaccugauggccagaaacagcgaccugagaaagcacaacgacauccugaccgccgagaucagccagauggagaacaacaacaccauccagagaaacaagaacgugaugagcaccaccguggugcccgccauccugagcguggcccugcugagcagcagcaucgcccccaucauggccgccagccccgacagccccaugaucaaccccuggccccacgccaagaacagagugggcaccggcauguacaaguacgacgagaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcauccaggugcagaagaccagcgugccccugcaggacgccaucugccaggagaacagcgacaccuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacaacagcaagcagaagaucugcaccggcgaccacaucuucugcgagaaguacgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucgugcccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacaugcuguacgugcugagacugauccccaagcagcugaagagccccgugggcuggcugagacuguucaucaacuggcugcugaccgcccugagaaucaagaccagaaacgugaugggcagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcagcaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcugguggcccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacaaggugaagagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucauccuguucaugaucaugaucagaaucgccgugaacagcaucaacaucaagaagaagaacuga

SEQ ID NO: 9434 - RNA, 3942 nt, Artificial Sequence
  derived and/or modified CDS sequence (opt4) from PTV(PAN479603)__KP272014.1__GP
augaucuucaccauccugaacauccugaccagagccaugcuggugaugagcauguacagccugaccaccugggacagcaccagcagaaacgacaugugcuucagcaacgacagcccccuggagggccugguguacuacugggagacccacagcaagagacacgacuacaagaagcaggagagccagaagugcagagugggcgacagcgacaagaagaugaucagcaacgugaccaucaucagccugaucagcgagauccagaagagcaucagcgagcugagccugagcugcggcaacgacgacaacagcaccggccaggugcugaccuucaacggccuggaggacaccaucagaggcgacuacaucguggacugcgugaccggccuguaccagagcgacaucggcgugggcgugggccugggcagaacccaccacgaccaccaccaggugaagaacaaggccguggugaucgacgagaaggagagaaugaucagccugcuggagacccagcagagcgagaacgacaucaagaugcaggugcugaugagcgagaucgagcagcugaagaaccagcugagcagaaagagaaacgagagaggccaggagaagagagacgccgagaaggugaugagcgaccugauggccagaaacagcgaccugagaaagcacaacgacauccugaccgccgagaucagccagaugaaguacgacaacaccauccagagaaacaagaacgugaugagcaccaccguggugcccgccauccugagcguggcccugcugagcagcagcguggcccccaucaucgccgccccccccgacagccccaugaucaaccccuggccccacgccaagaacagagugggcaccggcauguacaaguacgacgacaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaccuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacaacagcaagcagaagaucugcaccggcgaccacguguucugcgagaaguacgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucgugcccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacaugcuguacgugcugagacugauccccaagcagcugaagagccccgugggcuggcugaagcuguucaucaacuggcugcugaccacccugagaaucaagaccagaaacgugaugggcagaaucaaccagagaaucggcuggguggaccacuucgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacagagugaagagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucauccuguucaugauccugaucagaaucgccgugaacagcaucaacaucaagaagaagaacuga

SEQ ID NO: 9435 - RNA, 3942 nt, Artificial Sequence
  derived and/or modified CDS sequence (opt4) from PTV(PAN478718)__KP272017.1__GP
augaucuucaccauccugaacgugcugaccagagccaugcuggugaugagcauguacagccugaccaccugggacagcagcagcagaaacgacaugugcuucagcaacgacagcccccuggagggccugguguacuacugggagacccacagcaagaagcacgacuacaagaagcaggagagccagagaugcagagugggcgacagcgacaagaagaugaucaccaacgugaccaucaucagccugaucagcgagauccagaagagcaucagcgagcugagccugagcugcggcaacgacgacaacagcaccggccaggugcugaccuucaacggccuggaggacaccaucagaggcgacuacaucguggacugcgugaccggccuguaccagagcgacaucggcgugggcgugggccugggcagaacccaccacgaccaccagcaggugaagaacaaggccguggugaucgacgagaaggagagaaugaucagccugcuggagacccagcagagcgagaacgacaucaagaugcaggugcugaugagcgagaucgagcagcugaagaaccagcugagcaagaagagaaacgagagaggccaggagaagagagacgccgagaaggugaugagcgaccugauggccagaaacagcgaccugagaaagcacaacgacauccugaccgccgagaucagccagaugaaguacaacaacaccauccagagaaacaagaacaucaugagcaccaccguggugcccgccauccugagcguggcccugcugagcagcagcguggcccccaucauggccgccccccccgacagccccaugaucaaccccuggccccacgccaagaacagagugggcaccggcauguacaaguacgacgacaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaccuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacagcagcaagcagaagaucugcaccggcgaccacguguucugcgagaaguacgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucgugcccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacaugcuguacgugcugagacugauccccaagcagcugaagagccccgugggcuggcugaagcuguucaucaacuggcugcugaccgcccugagaaucaagaccagaaacgugaugggcagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucgugaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacaaggugaucagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucauccuguucaugauccugaucagaaucgccgugaacagcaucaacaucaagaagaagaacuga

SEQ ID NO: 9436 - RNA, 3942 nt, Artificial Sequence
  derived and/or modified CDS sequence (opt4) from PTV(Balliet)__KP272023.1__GP
augaucuucaccauccugaacgugcugaccagagccaugcuggugaugagcauguacagccugaccaccugggacagcaccagcagaaacgacaugugcuucagcaacgacagcccccuggagggccugguguacuacugggagacccacagcaagaagcacgacuacaagaagcagaagagccagagaugcagagugggcgacagcgacaagaagaugaucaccaacgugaccaucaucagccugaucagcgagauccagaagagcaucagcgagcugagccugagcugcggcaacgacgacaacagcaccggccaggugcugaccuucaacggccuggaggacaccaucagaggcgacuacaucguggacugcgugaccggccuguaccagagcgacaucggcgugggcgugggccugggcagaacccaccacggccaccagcagaugaagaacaaggccguggugaucgacgagaaggagagaaugauccugcugcuggagacccagcagagcgagaacgacaucaagaugcaggugcugaugagcgagaucgagcagcugaagaaccagcugagcaagaagagaaacgagagaggccaggagaagagagacgccgagaaggugaugagcgaccugauggccagaaacagcgaccugagaaagcacaacgacauccugaccgccgagaucagccagaugaagaacaagaacaccauccagagaaacaagaacaccgugagcaccaccguggugcccgccauccugagcguggcccugcugagcagcagcguggcccccaucaucgccgccccccccgacagccccaugaucaaccccuggccccacgccaagaacagagugggcaccggcauguacaaguacgacgagaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaccuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgccggccaggacgagcaggagguggagcacaaggcccugaagagagugagcgugaacgacugcaagaucguggacaacagcaagcagaagaucugcaccggcgaccacguguucugcgagaaguacgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggagcccagcaccagcgugaucgugcccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacauccuguacgugcugagacugauccccaagcagcugaagagccccgugggcuggcugaagcuguucaucaacuggcugcugaccgcccugagaaucaagaccagaaacgugaugggcagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacaacgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacaaggugaagaacugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucgugcuguucaugauccugaucagaaucgccgugaacagcaucaacaucaagaagaagaacuga

SEQ ID NO: 9437 - RNA, 3942 nt, Artificial Sequence
  derived and/or modified CDS sequence (opt4) from PTV(Adames)__KP272029.1__GP
augaucuucaccauccugaacgugcugaccagagccaugcuggugaugagcauguacagccugaccaccugggacagcagcagcagaaacgacaucugcuucagcaacgacagcccccuggagggccugguguacuacugggagacccacagcaagaagcacgacuacaagaagcagggcagccagaagugcagagugggcgacagcgacaagaagaugaucagcaacgugaccaucaucagccugaucagcgagauccagaagagcaucagcgagcugagccugagcugcggcaacaacgacaacagcaccggccaggugcugaccuucaacggccuggaggacaccaucagaggcgacuacaucguggacugcgugaccggccuguaccagagcgacaucggcgugggcgugggccugggcagaaucaaccacgaccaccagcaggugaagaacaaggccguggugaucgacgagaaggagaagaugaucagccugcuggagacccagcagagcgagaacgacaucaagacccaggugcugaugagcgagaucgagcagcugaagaaccagcugagcaagagaagaaacgagagaggccaggagaagagagacgccgagaagcugaugagcgaccugauggccagaaacagcgaccugagaaaccacaacgugauccugaccgacgagaucagccagaucaagaacaacaucaccauccacagaaacagaaacaugaugagcaccaccguggugcccgccauccugagcguggcccugcugagcagcagcgugggccccaucaccgccgccccccccgacagcaccaugaucaaccccuggccccacgccaagaacagagugggcaccggcauguacaaguacgacgagaacgacgagagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaucuacagcggccccaagauccccuucaagggcgugugcaagaucggccugaucaaguacaaggagugcaaguucaagaccagcagcuacgagaccaucagcuucaucacccugaagggcaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacaacagcaagcagaagaucugcaccggcgaccacaucuucugcgagaaguacgacugcagcaccagcuaccccgacgugaccugcauccacacccccggcagcggcccccuguacaucaaccugaugggcagcuggaucaagccccagugcgugggcuacgagagagugcugguggacagagaggugaagcagccccugcuggugcccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucauccccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccgccuucagcgugaccaccaacgugcuguacgugcugagacugauccccaagcagcugaagagccccgugggcuggcugaagcuguucgugaacuggcugcugaccgcccugagaaucaagaccagaagagugaugggcagaaucaaccagagaaucggcuggguggaccaccacgacguggagagacccagacacagagagcccaugagaagauucaagaccacccugcugcugacccugaucauggugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagauggagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucaucuucaucaacaaggugaagagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcaccagagacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccgugaucaaccccagcgagggcaccuggagcaucagcaacugguucagcggccugcuggacuggcugggcggccccaugaaggccauccugaagauccugggcuucaucgccaucggcaucgugugcuucauccuguucaugauccugaucagaaucgccgugaacagcaucaacaucaagaagaagaacuga

SEQ ID NO: 9438 - RNA, 3942 nt, Artificial Sequence
  derived and/or modified CDS sequence (opt4) from PTV(GML488831)__KP272032.1__GP
augaucuucaccauccugaacgugcugaccagagccaugcuggugaugagcauguacagccugaccaccugggacagcaccagcagaaacgacaugugcuucagcaacgacagcccccuggagggccugguguacuacugggagacccacagcaagaagcacgacuacaagaagcaggagagccagagaugcagagugggcgacagcgacaagaagaugaucaccaacgugaccaucaucagccugaucagcgagauccagaagagcaucagcgagcugagccugagcugcggcaacgacgacaacagcaccggccaggugcugaccuucaacggccuggaggacaccaucagaggcgacuacaucguggacugcgugaccggccuguaccagagcgacaucggcgugggcgugggccugggcagagcccaccacgaccaccagcaggugaagaacaaggccguggugaucgacgagaaggagagaaugaucagccugcuggagacccagcagagcgagaacgacaucaagaugcaggugcugaugagcgagaucgagcagcugaagaaccagcugagcaagaagagaaacgagagaggccaggagaagagagacgccgagaaggugaugagcgaccugauggccagaaacagcgaccugagaaagcacaacgacauccugaccgccgagaucagccagaugaaguacaacaacaccauccagagaagcaagaacgugaugagcaccaccguggugcccgccauccugagcguggcccugcugagcagcagcguggcccccaucauggccgccccccccgacagccccaugaucaaccccuggccccacgccaagaacagagugggcaccggcauguacaaguacgacgacaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugagccugcaggacgccaucugccaggagaacagcgacaacuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacaacagcaagcagaagaucugcaccggcgaccacguguucugcgagaaguacgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucgugcccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacaugcuguacgugcugagacugauccccaagcagcugaagagccccgugggcuggcugaagcuguucaucaacuggcugcugaccgcccugagaaucaagaccagaaacgugaugggcagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacaaggugagaagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaucggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucauccuguucaugauccugaucagaaucgccgugaacagcaucaacaucaagaagaagaacuga

SEQ ID NO: 9439 - RNA, 3942 nt, Artificial Sequence
  derived and/or modified CDS sequence (opt4) from PTV(GML488778)__KP272038.1__GP
augaucuucaccauccugaacgugcugaucagagccaugcuggugaugagcauguacagccugaccaccugggacagcaccagcagaaacgacaugugcuucagcaacgacagcccccuggagggccugguguacuacugggagacccacagcaagaagcacgacuacaagaagcaggagagccagagaugcagagugggcgacagcgacaagaagaugaucaccaacgugaccaucaucagccugaucagcgagauccagaagagcaucagcgagcugagccugagcugcggcaacgacgacaacagcaccggccaggugcugaccuucaacggccuggaggacaccaucagaggcgacuacaucguggacugcgugaccggccuguaccagagcgacaucggcgugggcgugggccugggcagaacccaccacgaccaccagcaggugaagaacaaggccguggugaucgacgagaaggagagaaugaucagccugcuggagacccagcagagcgagaacgacaucaagaugcaggugcugaugagcgagaucgagcagcugaagaaccagcugagcaagaagagaaacgagagaggccaggagaagagagacgccgagaaggugaugagcgaccugauggccagaaacagcgaccugagaaagcacaacggcauccugaccgccgagaucagccagaugaaguacaacaacaccgugcagagaagcaagaacgugaugagcaccaccguggugcccgccauccugagcguggcccugcugagcagcagcguggcccccaucauggccgccccccccgacagccccaugaucaaccccuggccccacgccaagaacagagugggcaccggcauguacaaguacgacgacaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugagccugcaggacgccaucugccaggagaacagcgacaacuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgccggccaggacgagcaggagguggagcacagagcccugaagagagugagcgugaacgacugcaagaucguggacagcagcaagcagaagaucugcaccggcgaccacguguucugcgagaaguucgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucgugcccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacaugcuguacgugcugagacugauccccaagcagcugaagagccccgugggcuggcugaagcuguucaucaacuggcugcugaccgcccugagaaucaagaccagaaacgugaugggcagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagagccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucaucuucaucaacaaggugagaagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccugguguacaugggcguguacgacuucagaaacaagaccggcggcagcagcaccguggugaaccccagcgagggcgccuggagcaucagcaacugguucagcggccugcuggacuggcugggcggccccaugaaggccaucaucaagauccugggcuucaucgccaucggcguggugugcuucauccuguucaugauccugaucagaaucgccgugaacagcaucaacaucaagaagaagaacuga

SEQ ID NO: 9440 - RNA, 3945 nt, Artificial Sequence
  derived and/or modified CDS sequence (opt4) from PTV(Adames)__DQ363407.1__GP
augaucuucaccauccugaacgugcugaccagagccaugcuggugaugagcauguacagccugaccaccugggacagcagcagcagaaacgacaucugcuucagcaacgacagcccccuggagggccugguguacuacugggagacccacagcaagaagcacgacuacaagaagcagggcagccagaagugcagagugggcgacagcgacaagaagaugaucagcaacgugaccaucaucagccugaucagcgagauccagaagagcaucagcgagcugagccugagcugcggcaacaacgacaacagcaccggccaggugcugaccuucaacggccuggaggacaccaucagaggcgacuacaucguggacugcgugaccggccuguaccagagcgacaucggcgugggcgugggccugggcagaaucaaccacgaccaccagcaggugaagaacaaggccguggugaucgacgagaaggagaagaugaucagccugcuggagacccagcagagcgagaacgacaucaagacccaggugcugaugagcgagaucgagcagcugaagaaccagcugagcaagagaagaaacgagagaggccaggagaagagagacgccgagaagcugaugagcgaccugauggccagaaacagcgaccugagaaaccacaacgugauccugaccgacgagaucagccagaucaagaacaacaucaccauccacagaaacagaaacaugaugagcaccaccguggugcccgccauccugagcguggcccugcugagcagcagcgugggccccaucaccgccgccccccccgacagcaccaugaucaaccccuggccccacgccaagaacagagugggcaccggcauguacaaguacgacgagaacgacgagagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaucuacagcggccccaagauccccuucaagggcgugugcaagaucggccugaucaaguacaaggagugcaaguucaagaccagcagcuacgagaccaucagcuucaucacccugaagggcaagggcaagaucuacaucgagcaccugaugcugaagaacaucgagguggugaccaacgugagcuucgugugcuacgagcacgccggccaggacgacgagcaggagguggagcacagagcccugaagagagugagcgugaacgacugcaagaucguggacaacagcaagcagaagaucugcaccggcgaccacaucuucugcgagaaguacgacugcagcaccagcuaccccgacgugaccugcauccacacccccggcagcggcccccuguacaucaaccugaugggcagcuggaucaagccccagugcgugggcuacgagagagugcugguggacagagaggugaagcagccccugcuggugcccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcgugaucauccccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccgccuucagcgugaccaccaacgugcuguacgugcugagacugauccccaagcagcugaagagccccgugggcuggcugaagcuguucgugaacuggcugcugaccgcccugagaaucaagaccagaagagugaugggcagaaucaaccagagaaucggcuggguggaccaccacgacguggagagacccagacacagagagcccaugagaagauucaagaccacccugcugcugacccugaucauggugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagauggagcuggugacccugggcagccugggcaccaaguuccugaacuggggcacccugagccugagccuggacgccgagggcaucagcggcaccaacagcaucagcuuccuggagagcagcaagggcggcuucgcccuguacgacgagggcuacagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucaucuucaucaacaaggugaagagcugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcaccagagacuacugccaggugcugcacuuccagaagccccugguggacgagagacugagcuacagcugcggcagcgagcccaagcugaucgugaucaagggcacccugguguacaugggcguguacgacuucagagacaagaccggcggcagcagcaccgugaucaaccccagcgagggcaccuggagcaucagcaacugguucagcggccugcuggacuggcugggcggccccaugaaggccauccugaagauccugggcuucaucgccaucggcaucgugugcuucauccuguucaugauccugaucagaaucgccgugaacagcaucaacaucaagaagaagaacuga

SEQ ID NO: 9441 - RNA, 3942 nt, Artificial Sequence
  derived and/or modified CDS sequence (opt4) from PTV__M11156.1__GP
augaucuucaccauccugaacgugcugaccagagccaugcuggugaugagcauguacagccugaccaccugggacagcaccagcagaaacgacaugugcuucagcaacgacagcccccuggagggccugguguacuacugggagacccacagcaagagacacgacuacaagaagcaggagagccagagaugcagagugggcgacagcgacaagaagaugaucaccaacgugaccaucaucagccugaucagcgagauccagaagagcaucagcgagcugagccugagcugcgugaacgacgacaacagcaccggccaggugcugaccuucaacggccuggaggacaccaucagaggcgacuacaucguggacugcgugaccggccuguaccagagcgacaucggcgugggcgugggccugggcagaacccaccacggccaccagcagaugaagaacaaggccguggugaucgacgagaaggagagaaugaucagccugcuggagacccagcagagcgagaacgacaucaagaugcaggugcugaugagcgagaucgagcagcugaagaaccagcugagcaagaagagaaacgagagaggccaggagaagagagacgccgagaaggugaugagcgaccugauggccagaaacagcgaccugagaaagcacaacgacauccugaccgccgagaucagccagaugaagaacaagaacaccauccagagaaacaagaacaccgugagcaccaccguggugcccgccauccugagcguggcccugcugagcagcagcguggcccccaucaucgccgccccccccgacagccccaugaucaaccccuggccccacgccaagaacagagugggcaccggcauguacaaguacgacgagaacgacgacagcggcugcagacccaucagauacggcgugagcugcaucggcuucgacuucaugcugaagauggacaaguaccccuucuucaacgccuucaucggccacaagaccccccuggagagcuucgccgacaagaucaucgagaaggaggaggagaccugcgagaucggcaccaacaaggaguucaagugcuucgaggagagagccuacaucaagggcaccugccccaccaacaucaacgccgugcacuacaucgacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggagaacagcgacaccuacagcggccccaagauccccuucaagggcgugugcaagaucggccugaucaaguacaaggagugcaaguucaagaccagcagcuacgagaccgugagcuucaucacccugaaggagaagggcaagaucuacaucgagcaccugaugcugaagaacaucgagguggugaccaacgugagcuucgugugcuacgagcacgugggccaggacgagcaggagguggagcacagagcccugaagagagugagcgugaacgacugcaagaucguggacaacagcaagcagaagaucugcaccggcgaccacguguucugcgagaaguacgacugcagcaccagcuaccccgacgugaccugcauccacgcccccggcagcggcccccuguacaucaaccugaugggcagcuggaucaagccccagugcgugggcuacgagagagugcugguggacagagaggugaagcagccccugcuggcccccgagcagaacugcgacaccugcgugagcgagugccuggacgagggcgugcacaucaagagcaccggcuucgagaucaccagcgccguggccugcagccacggcagcugcaucagcgcccaccaggagcccagcaccagcgugaucgugcccuaccccggccugcuggccagcgugggcggcagaaucggcauccaccugagccacaccagcgacagcgccagcgugcacauggugguggugugcccccccagagacagcugcgccgcccacaacugccugcugugcuaccacggcauccugaacuaccagugccacagcacccugagcgccauccugaccagcuuccugcugauccuguucaucuacaccguguucagcgugaccaccaacauccuguacgugcugagacugauccccaagcagcugaagagccccgugggcuggcugaagcuguucaucaacuggcugcugaccgcccugagaaucaagaccagaaacgugaugagaagaaucaaccagagaaucggcuggguggaccaccacgacguggagagacccagacacagagagcccaugagaagauucaagaccacccugcugcugacccugaucaugaugaccggcggcaacgccugcagcaacaccgugguggccaacagcaagcagaccagaugcgugcaggagggcagcaacaccaagugcagcaucaccgccaccaucacccugagagccggcgugaucggcgccgagagcugcuucaucaucaagggccccauggagaaccagcagaagaccaucagcaucaagaccaucagcagcgagaccgugugcagagagggcagcagcuucuggaccagccuguacauccccagcugccugagcagcagaagaugccaccuggugggcgacugcgugggcaacaagugccagagcuggagagacgaccagcugagcagagaguucagcggcgugaaggacaaccacaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccccggcaccaaguuccugaacuggggcacccugagccugagccuggacgccgagggcaucagcggcaccaacagcaucagcuuccuggagagcagcaagggcggcuucgcccuguacgacgagggcuacaacgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaacggcgccaucaaggcccugcugagcaucaaccuggacgaccacgagaucguguucaucaacaaggugaagaacugcgacgccaccuuccugaacgugagcggcugcuacagcugcgacuacggcgcccacgugugcgugaaggugaagagcagcgagagcgccgacuucuucgccgagagcgaggacaagaccaccgugcugagcuuccccauccagagcggcacccacgacuacugccaggugcugcacuuccagaagccccugguggacgagagacugagcuacagcugcggcagcgagcccaagcugaucgugaucaagggcacccuggugugcaugggcguguacgacuucagaaacaagaccggcggcagcagcaccguggugaaccccagcgagggcgccuggagcaucagcaacugguucagcggccugcuggacuggcugggcggccccaugaaggccauccugaagauccugggcuucaucgccaucggcaucgugugcuucgugcuguucaugauccugaucagaaucgccgugaacagcaucaacaucaagaagaagaacuga

SEQ ID NO: 9442 - RNA, 3852 nt, Artificial Sequence
  derived and/or modified CDS sequence (opt4) from Phlebovirus(CoAr170255)__HM566149.1__GP
auguacaagcugaucaccaacauccugaagcugagcguggugagcgccauguacagcaucauguucugggaccccaccggcaucagcaagcugugccugagcaacaacagcccccuggagggccugguguacuacugggagaacaccaugagagagggcgaguucaagagagagaagagaaagaagugcagacugggcaucagcgagcccgcccccgugagcaaccagaccaucgugagccugaucgaggaggugcagaagagccccgccgagaugauccugaucugcgaggccaacggcaacagcaccggcagcagccugagcuucgacggccugagcgacaacgagaucaagcccagcaucguggacugcaccaccggcgacagaaccagcgaccugagagugcuggugggcaagggcaucuucgagaagaagaugagcaugagcaacgagaucgacagaguggugagccuggaggaccaccugcagagagagaaggagcuggugcagaccuuccaggaccugcaccacaacgagagcgagaagaacaagcugcuggagcacgagcuggagaacgugagacagcagcugaagagagagagagagagcaacaagaucaagauguggaccaccaagagacccgagaucaccaccaucggccugaccaccaccaucgccaccauccugcuggccagccagagcguggccagcagcgugcccaugcccggccagcugaacaccuggccccacgccaagaacagagugggcggcggcguguucaaggccaacgacgacgacgaggacagcugcaagcugaucgacuacggcaucgccugccacggcuucgacuaccugcugagaaccgacaucuaccccuucuucaacgcccacgugagccacagaagccugcuggaggccagcaacgagggcaucauccugaaggacgaggccagcugcgagaucgagaccaacaaggacuucaagugcuacgaggagagagccuuccugaaguggagcugcccccaccuggugaacagcgcccacuucaucgacagcaagggcaagcugagaaucaucaagugcaaggccgaguacgagaucaccgaggacugcaccuacugcagaagaaucaagaagaaggccgcccagcagaagcagguguacaagagcagcaucgcccugcaggacgccgugugccaggagaacagcgacuacuacgacggccccagaaucaccuucaccggcgugugcaagaucggcaccauggaguacaagaagugcaagcacaagagcagcagcuucgagaacaucggcuucaucaccaucagagacaagggcaaguacuacaucgagaacaugagaaccaagaacaucgagauggugagcaacgugagcuucaucugcuacaaccacaacggccaggacaccgagaaggacgugagacugcugaagagagugaagcccggcgacugcaaggugguggacgacagcaagaccaagcacugcaccggcgaccacguguucugcgagaaguacgacugcaccaagagcuaccccgaggccaccugcaugcacgcccccggcagcggccccauccuggugcuggugaugggcgugugguucaagccccagugcgugggcuacgagagagugcugguggagagagaggugaaggcccccgugcugauccaggagaaggacugcgacaccugcguguucgagugccuggaggacaagauccugaucaagagcaccggcuucaagaugaucagcgccguggccugcagccacggcagcugcgugagcagccaccagagccccagcaccuuccuguacaucgacuaccccggccugaccgccagcgugggcggcgagaucggccugcaccugagccacaccgacgacagcgugagcgugcacaagaagauccacugccccgccagagaccccugcgaggcccacagcugcaucgugugcuaccacggccuggugaacuaccagugccacaccgugcugagcuacagcguggugagcuuccugcuggugugcaugauguaccuggccuucuucaucaccagcagacugcuguucuuccugagaaucaugcccagaagacugagaaaccccaucagcuggcugacccugcugaucagaugggugcugcagacccugcuggccauccugagacugagcuucaagaagcugagcgagaccaucggcuggaacagccccaacaacagacagcagauggacguggaggccaacagaagaccccugagaagauacagaaccaccuucauccugacccugcuguucgugggccugaccagcgccugcagcaacaccgccgugagcaacagcaagcagaccaagugccugcagagcggcggcagcgugaagugcagcaucaccgccaccaucacccugaaggccggcaccaucggcgccgagagcugcuucaucaucaagggccccagcgagaaccagcagaaggugaucagagugaagaccgugagcagcgagaccgugugcagagagggcagcagcuucuggaccggccaguucacccccagcugcgugagcagcagaagaugccaccuggugggcgacugcgugggcaacagaugccaggccuggagagacgagguggugagcagagaguucggcaacaugaaggacaacaacgugaugagcgagaacaagugcuucgagcagugcggcgccgccggcugcggcugcuucaacaucaaccccagcugccuguacgugcacagcaccuucaagagcgugagaagagaggccaucagaguguucaagugcaacgacugggugcacagacugaccuucgaggugagcggccccagcggcgagaaggacagaaucgugcugaacagccugagcaccaaguuccugcaguggggcaccaucagccugagccuggacgccgagggcaucagcggcaccaacagcuacagcuuccuggagagcaacaagggcggcuucgccauccacgacgaggaguucagcgagauccccagagagggcuaccugggcgagaucagaugcagcagcgagagcgccgugaucgccgcccacaagagcugcaucagagcccccaaccugaucaaguacaagcccaugaccgaccagaucgacugcaccgccagccugguggaccccuucgccaucuuccugaagggcagccugccccagagcagaagcggcuacaccuucaccagcagcaccgacaagaagaccgugcaggccuucaacagcggcagcaucaaggcccugaucagcaucaacauggacgaccacgagaucgaguuccugaacgacgccgccgacugcgacgccaccuuccugaacgugagcggcugcuacagcugcaacuacggcgcccaggugugcaucaaggugagaagcagcaagagcagcaucuucagcagcaacaacaacgacaacagcaucgugaucaacuucgacgccgaccagggcaccagagacuacugcagaaucauccacuucaacggcccccugguggacgagacccugcacuacagcugcggcggcgagagcaagcugcugcagaugaagggcagccugaucaccgugggccccuacgacuucagaaacaccaccggcggcaagagcaccaucgugaacccccacgaggagagcuggaaccuguucagcugguucagcggccugcuggacuggcugggcggcccccugagagccauccugaagaucgugcugaucaucaucaucggcaucauccuguucaucgugguggccuuccugaucagacuggugaucuucaacgugcugcugaagagcaagaagaacuga

SEQ ID NO: 9443 - RNA, 3873 nt, Artificial Sequence
  derived and/or modified CDS sequence (opt4) from Phlebovirus(CoAr171616)__HM566154.1__GP
auguuccagaucaucuaccugcugaccaagcuguaccuggugagcagcauguacagcaucauguucugggagaacgagaacaucagcaagcugugccugagcaacaacagcccccuggagggccugguguacuacugggagaacgugaugaaggagggcgacuucaaggaggagaagagaaagaagugcagaaucggccccagcgaccugaagagagugaccaaccagacccugaccacccugaucgaggaggugcagaagagccccagcgagauccagcugcugugcgaggaggacggcaacaagaccggcaucagcauguucuucgacggccugagcgacgacaucagcacccccagcaucguggacugcaacggcaacaucagaaucagcgaccugagagugcaggugggcagaggccacuucgagaaggagaacgagaucagaaagaucgaggagaucgugacccuggaggacgaccugagaagagagagagaccugaacaagcugcugcaggaccugaacaagaaggacgccgaggagagaagaaucaucgagcacgagcugaccaacaugagagagcagcugcagagagagagagagagaagcaagcagcagaucaaggagcacgagaagaucgaggugaacaaccacaaggagcccgccacccaccugaacgugagcaagcugcugaccaucggccugcuggcccagcaggugggccaggugaucgccaccgagcccggccagcugaacaccuggauccacgccaagaacagaaucggcaagggccuguacaagaccgaggacaccgacgaggacggcugcagaggccuggacuacggcgugagcugccugggcuucgacuaccugcugagaaccgacaucuaccccuucuucaacagcuucgugagccaccugagcaugcuggaggccagcaccgaggaccugaucgagaaggagggcaccagcugcgagaucgagaccaacaaggaguucaagugcuacgaggagagagccuucaucaagggcagcugcccccaccuggugaacagcgcccacuuccuggacaacaagggcaagcugagaaucgugaagugcaagaccgacuucgagaugaccgaggacugcaccuucugcagaaagaucaagaagaagaacagccagcacaagcagguguucaagaccagcaucgcccugcaggacgccgugugccagaacaacagcgaccuguacaacggccccagaaucguguacagcaacgugugcaagaucggcauggugagcuacaagcagugcaagagcaagaccagcagcuacgagagcgugggcuucgugauccugaagggcaagggcaaguucuacaucgagaacaugaagaucaagaacaucgaggugaucgccaacgugagcuucaucugccaccaguaccagggccaggacggcaccgagaaggagcagagaagccugaagagaaucagcgugggcgagugcaagagcgugaacccccagaagaccaagcacugcaccggcgaccacguguucugcgagaaguacgacugcaccaagagcuaccccgaggugaccugccugauggcccccggcagcggccccauccuggugcagaucaugggcagcuggaucaagccccagugcgugggcuacgagaaggugcugguggagagagaggugaagagccccacccugaccgaggagagagacugcgacaccugcguguacgagugccuggaggacaagauccugaucaagagcaccggcuucaagaugaucagcgccguggccugcagccacggcaugugcgugagcagccaccaggagcccagcaccuuccuguacaucaacuaccccggcaugagcgccagcaucggcggcgagaucggccugcaccugagccacaccgacgacagccugagccugcacaaggugaucagcugccccagcagaaaccccugcgacgugcacagcugcaucaucugcuaccacggcaucaucaacuaccagugccacaccgcccugagcuacaccaucguggccuucagcuucaucagcuuccuguaccugaccuucaaggugaucagccagcugcuguacaccuucaagguggugcccaagaagcugaagggccccuucuacuggaugggcuaccugaucaaguggaucgugaagaccauccugggcguggugagaaacaccuucuucaccaugagcaacagaaucggcugggagagaagagacgagauccacgaggacaucgaggccaaccccagaagacaccugcagagauucaagaccaccuucgugcugaccaugcugaugaucaacggcggccugugcugcagcaacacccuggugagcaacagcaagcagaccagaugcgugcagagcggcaacgaggugaagugcagcgugagcgccaccguggugcugaaggccggcgugaucggcgccgagagcugcuucaucaucaagggccccagcgagaaccagcacaagaugaucagcgugagaacccugagcagcgagaccgugugcagagagggcgccagcuucuggaccggccacuucagccccagcugcgugagcagcagaagaugccaccuggugggcgagugccacggcaacagaugccagagcuggagagacgaccagaucagcagagaguucggcggcgugaaggacaacaacagaaugagcgagaacaagugcuucgagcagugcggcagcaucggcugcggcugcuucaacaugaaccccagcugccuguacgugcacaccacccugaagagcgccagaaacgaggccgugagaguguucaagugcaacgacuggauccacagacugaacuucgaggugaucggccccagcggcgagaaggacguggugacccugaacagcaugagcaccaaguuccugcaguggggcaccaucagccugagccuggacgccgagggcaucaccggcaccaacagcuacagcuuccuggagagcagcaagggcggcuucgccauccacgacgaggaguucagcgacauccccagagagggcuaccugggcgagaucagaugcagcagcgagagcgccgugaucagcgcccacagcagcugcaucagagcccccgaccugaucaaguacaagcccaugaccgaccagaucgagugcaccagcacccugaucgaccccuucgccaucuucaugaagggcagccugccccagaccagaagcggcuacaccuucaccagcagcaaggacaagaagaccauccaggccuucaacaccaacagcaucaaggcccugaucagccugaaccuggacgaccacgagaucguguucgugagcgaccagaccaacugcgagugcaccuuccugaaccugaccggcugcuacagcugcgacuacggcgcccacgugugcuucagaaucaagagcgacaagaagggcguguucgugagcaacaccgaggccaaggacaucagcuucggcuucgaggugcugaccggcacccacgacuacugccagauccagcacuucaacagccccagcguguacaagacccugagcuacagcugcggcggcgagagcaagcugcuggugaucaagggcagccugaucaccaucggcccccacgacuacagaaacaagaccggcggcgccagcaccguggugaaccccagcgaggagggcuggagcgugaccaacuggaucggcggcuucaucagcuggcugggcggcccccugaaggcccugcugaagaucgccgugaccauccuggccggcguggugaucuuccugaucaucuacuucuuccugagacugaucgccaccaacauccugaugaagaccaagaagaacuga

SEQ ID NO: 9444 - RNA, 3852 nt, Artificial Sequence
  derived and/or modified CDS sequence (opt4) from Buenaventura virus(CoAr3319)__KP272002.1__GP
auguacaagcugaucaccaacauccugaagcugagcauggugagcgccauguacagcaucauguucugggaccccaccggcaucagcaagcugugccugagcaacaacagcccccuggagggccugguguacuacugggagaacaccaugagagagggcgaguucaagagagagaagagaaagaagugcagacugggcaucagcgagcccgcccccgugagcaaccagaccaucgugagccugaucgaggaggugcagaagagccccgccgagaugauccugaucugcgagaccagcggcaacgccaccggcagcagccugagcuucgacggccugagcgacaacgaggugaagcccagcaucguggacugcgccaccggcgagagaaccagcgaccugagagugcuggugggcaagggcaccuucgagaagaagaugagcaugagcaacgagaucgacagaguggugagccuggaggaccaccugcagagagagagagagcuggugcagaccuuccaggaccugcaccacaacgagagcgagaagaacaagcugcuggagcacgagcuggagaacgugagacagcagcugagaagagagagagagagcaacaaggugaagguguggaccaccaagaagcccgaggugaccaccaucggccugaccaccaccaucgccaccauccugcuggccagccagagcaucgccagcagcgugcccaugcccggccagcugaacaccuggccccacgccaagaacagagugggcggcggcguguucaaggccaacgacgacgacgaggacagcugcaagcugaucgacuacggcaucgccugccacggcuucgacuaccugcugagaaccgacaucuaccccuucuucaacgcccacgugagccacagaagcaugcuggaggccagcaacgagggcaucauccugaaggacgaggccagcugcgagaucgagaccaacaaggaccugaagugcuacgaggagagagccuuccugaaguggagcugcccccaccuggugaacagcgcccacuucaucgacagcaagggcaagcugagaaucaucaagugcaaggccgaguacgagaucaccgaggacugcaccuacugcagaagaaucaagaagaaggccgcccagcagaagcagguguacaagagcagcaucgcccugcaggacgccgugugccaggagaacagcgacuacuacgacggccccagaaucaccuucaccggcgugugcaagaucggcagcauggaguacaagaagugcaagcacaagagcagcagcuucgagaacgugggcuucaucaccaucagagacaagggcaaguacuacaucgagaacaugagaaucaagaacaucgagauggugagcaacgugagcuucaucugcuacaaccacaacggccaggacaccgagaaggacaucagacugcugaagagagugaagcccagcgacugcaaggugguggacgacagcaagagcaagcacugcaccggcgaccacaucuucugcgacaaguacgacugcaccaagagcuaccccgaggccagcugcaugcacgcccccggcagcggccccauccuggugcuggugaugggcgugugguucaagccccagugcgugggcuacgagagagugcugguggagagagaggugaaggugcccgugcugacccaggagaaggacugcgacaccugcguguucgagugccaggaggacaagauccugaucaagagcaccggcuucaagaugaucagcgccguggccugcagccacggcagcugcgugagcagccaccagagccccagcaccuuccuguacaucgacuaccccggccugaccgccagcgugggcggcgagaucggccugcaccugagccacaccgacgacagcaucagcgugcacaagaagauccacugccccgccagagaccccugcgaggcccacaacugcgugaucugcuaccacggccugaucaacuaccagugccacaccuuccugagcuacagcguggugagcuuccuguucaucagcgugcuguaccugaccuucuucaucgugagcagacugcugcuguuccugaagaucaugcccaagagacugaagaaccccaucagcuggcugacccugcugaucagaugggugcugcagacccugaucaccauccugagacugagcuucaagaagcugagcgagaccaucggcuggaccaccaacgacaacagacagcacguggacguggaggccaacagaagaccccugagaagauacagaaccaccuucauccugacccugcuguucaucggccuggccagcggcugcagcaacaccgccgugagcaacagcaagcagaccaagugccugcagagcggcggcagcgugaagugcagcaucaccgccaccaucacccugaaggccggcaucaucggcgccgagagcugcuucaucaucaagggccccagcgagaaccagcagagagugaucagagugaagaccaucagcagcgagaccgugugcagagagggcagcagcuucuggaccggccuguucacccccagcugcgugagcagcagaagaugccaccuggugggcgacugcgugggcaacagaugccagagcuggagagacgagguggugagcagagaguucggcaacaugaaggacaacaacgccaugagcgagaacaagugcuucgagcagugcggcgccgccggcugcggcugcuucaacaucaaccccagcugccuguacgugcacagcguguucaagagcgugagaagagaggccaucagaguguucaagugcaacgacugggugcacagacugaccuucgaggugagcggccccagcggcgagaaggacagaaucgugcugaacagccugagcaccaaguuccugcaguggggcaccaucagccugagccuggacgccgagggcaucagcggcaccaacagcuacagcuuccuggagagcaacaagggcggcuucgccauccacgacgaggaguucagcgagauccccagagagggcuaccugggcgagaucagaugcagcagcgagagcgccgugaucgccgcccacaagagcugcaucagagcccccaaccugaucaaguacaagcccaugaccgaccagaucgacugcaccgccagccugguggaccccuucgccaucuuccugaagggcagccugccccagagcagaagcggcuacaccuucaccagcagcaccgacaagaagaccgugcaggccuucaacagcggcgccaucaaggcccugaucagcaucaaccuggacgaccacgagaucgaguuccugagcgacaccgccgacugcgacgccaccuuccugaacaucagcggcugcuacagcugcaacuacggcgcccaggugugcaucaaggugagaagcagcaagagcagcaucuucagcagcaacaacaacgacaacagcaucgugaucaacuucgacgccgagcagggcaccagagacuacugcagaaucauccacuucaacggcccccugguggacgagacccugcacuacagcugcggcggcgagagcaagcugcugcagaugaagggcagccugaucaccgugggccccuacgacuucagaaacaccaccggcggcaagagcaccguggugaacccccacgaggagagcuggaaccuguucagcugguucagcggccugcuggacuggcugggcggcccccugagagccauccugaagaucgugcugaucgugaucaucggcaucauccuguucaucguggugguguuccugaugagacuggccauccugaacgugcugcugaagagcaagaagaacuga

SEQ ID NO: 9445 - RNA, 3942 nt, Artificial Sequence
  derived and/or modified CDS sequence (opt4) from Cocle virus(GML244915)__KP272034.1__GP
augauguucacccaccuggacgugcugaccagagccaugcuggugaugagcauguacagccugaccaccugggacagcaucagaagaaacgacaucugcuucagcaacgacagcccccuggagggccugguguacuacugggagacccagagcaagaugcacgaguacaagaaggaggacagccagaagugcagagugggcgacagcgagaagaagaugaucagcaacgugaccaucaucagccugaucagcgagauccagaagagcaucagcgagcugagccugagcugcggcaacgacgacaacagcaccggccaggugcugauguucaacggccuggaggacaccaucagaggcgacuacaucguggacugccugaccggccuguaccagagcgacaucggcgugggcgugggcagcggcaagaccaagcacgaccacaccaagcugagaaacaaggccgugaucaucgacgagaaggagaagaugaucagccugcuggaggcccagcagagcgagaacgacaucaagacccaggugcugaugagcgagaucgagcagcugaagacccagcugcugaacagaagaagcgagagaggccacgagaagagaaagaacgaggagaucgugagcgaccugauggccagaaacagcgaccugagaaagcacaacgacauccugaaggacgagauggaccagaucaaggagaaccugaccaucuucaagagcagaaacgccaucagcaccaccagcgugcccgccaucaugagcaucgcccugcugagcagcagcgugaugcccaucaucgccgccgugagcgacagccccaugaucaaccccuggccccacgccaagaacagagugggcagcggcauguacaaguacgacgacaacgacgagagcggcugcagacccaucagauacggcgugagcugcaucggcuucgaccacaugcugaagauggacaaguaccccuucuucaacgccuucaucggccacaagacccugcuggagagcuucguggacaagaucaucgagaaggaggacgagaccugcgagaucggcaccaacaaggaguucaagugcuucgaggagagagccuacaucaagggcaccugcccccacaacaucaacgccgugcacuaccuggacaacaagggcaagcugagauacgugaagugcaaggagaaccuggagaugaccgaggacugcgccuucugcagaaagaucaagaagaaggccggccagagcgugcaggugcagaagaccagcgugccccugcaggacgccaucugccaggacaacagcgacaucuacaccggccccagaauccccuacaagggcaugugcaagaucggccuggugaaguacaaggagugcaagagcaagaccagcagcuacgagaccgugagcuucaucacccugaagggcaagggcaagaucuacaucgagcaccugaugcugaagaacaucgagguggugaccaacgugagcuucgugugcuacgagcacgccggccagguggagcaggagguggagcacagagcccugaagagagugagcgugaacgacugcaagaucguggacagcagcaagcagaagaucugcaccggcgaccacguguucugcgagaaguacgacugcagcaccagcuaccccgacgugaccugcauccaggcccccggcagcggcccccuguacgugaaccugaugggcagcuggaucaagccccagugcgugggcuacgagagagugcugguggagagagaggugaagcagccccugcugacccccgagcagaacugcgacaccugcgugagcgagugccuggacgagggcgugcacaucaagagcaccggcuucgagaucaccagcgccguggccugcagccacggcagcugcaucagcgcccaccaggaggccagcaccagcaucaucgugcccuaccccggccugcuggccagcgugggcggcaagaucggccugcaccugagccacaccagcgacagcgccagcgugcacaugaucguggugugcccccccagagacagcugcgccgcccacaacugccugcugugcuaccacggcaugcugaacuaccagugccacagcacccugagcgccauccugaccagcuuccugcugauccuguucaucuacaccaccuucagcuucaucaccaacauccuguaccugcugagacugcugcccaagcagcugaagagccccaucggcuggcugaagcuguucaucaacuggcuguucaccauccugagaaucagaaccaaguaccugaugggcagacugaaccagagaaucggcuggguggagaaccacgacguggagagacccagacccagagagcccaugagaagauucaagaccacccugaugcugaccaugcugaugaucaccggcggcuacgccugcagcaacaccgugguggccaacagcaagcagaccagaugcgugcaggagggcagcaacaccaagugcagcgugaccgccaccgugacccugaaggccggcgugaucggcgccgagagcugcuucgugaucaagggccccauggagaaccagcagaagaccaucagcaucaagaccgugagcagcgagaccgugugcagagagggcagcagcuucuggaccagccuguacauccccagcugccugagcagcagaagaugccaccuggugggcgacugcgugggcaacagaugccagagcuggagagaggaccagcugagcagagaguucagcggcgugaaggacaaccagaucaugaacgagaacaagugcuucgagcagugcggcgccaucggcugcggcugcuucaacaucaaccccagcugccuguacgugcacgccuaccugaagagcgccagaaacgaggccgugagaguguucagcugcagcgacugggugcacagagugagcuucgaggugaagggccccgacggcgagaccgagcuggugacccugggcagccugggcaccaaguuccugaacuggggcacccugagccugagccuggacgccgagggcaucaccggcaccaacagccugagcuuccuggagagcagcaagggcggcuucgcccuguacgacgagggcuucagcgagauccccagagagggcuuccugggcgagaucagaugcagcagcgagagcgccgccaucagcgcccacaagagcugcaucagagcccccggccugaucaaguacaagcccaugaccgaccagaucgagugcaccgccagccugguggaccccuucgccaucuuccugaagggcagccugccccagaccagaaacggccagaccuucaccagcaccaaggacaagaagaccgugcaggccuucaccaccggcgccaucagagcccugcugagcaucaaccuggacgaccacgagaucaccuucaucagcaagaucaagaacugcgaggccaccuuccugaacgugagcggcugcuacagcugcgacuacggcgcccacgugugcaucaagaucaagagcagcgagagcgccgacuucuacgccgagagcgaggacaagaccaccgugcugagccugcccgugagcagcggcacccaggacuacugccaggugcugcacuuccagaagccccugguggacgagagacugagcuacagcugcggcagcgagcccaagcugauggugaucaagggcacccugguguacaugggcguguacgacuucagaaacaagaccggcggcagcagcaccguggugaaccccagcgacgccagcuggagcaucgccaacugguucagcggccugcuggacuggcugggcggcccccugaaggccauccugaagauccugggcuucaucgccaugggcguggugugcuucauccuguucaugauccugaucaagaucgccgugagaagcgugaacaugaagaagaagaacuga

SEQ ID NO: 9446 - RNA, 3873 nt, Artificial Sequence
  derived and/or modified CDS sequence (opt4) from Campana virus(VP-334K)__KP272041.1__GP
augcugcacuucaucaccaucaccaccaaguuccuggccguggccagcauguacaaccugcuguacugggaccccaacggccugagcagacugugccugagcaacaacagcccccuggagggccugguguacuacugggagaaccugaugaaggagagcgacuucaagaaggacaagaagaagcacugcagaaucggcaccagcguggccgcccccgugaccaacgagacccugaccacccugaucgaggaggugcagaagagccccagcgagaucauccugcagugcgagagcagaaacaacgacaccggcaacagcaucuacuucgacggccuggccgacgacaucgagagccccagcaucgugaacugcgagagcggcaagagagagagcgaccugagagugcuggugggccagggccugaagaaggagaucauccugaacgagaucgccgccaucgacagacaggccagccuggaggagcaccugagaggcgagaaggcccugaccagccugcugcaggagaucagcaagcaggacgaggccgagagaaagagacuggagcacgaggugagcagccugagacagcagcugaugaacgagagagaggagaacaagaagagaaagaacauccccgccuucggcgugagcagcaccaccagcagcagccugaugaacaucagcagaguggugaccaucggccugcugagccagcaggccaucgccaaccccagccugcccggccaggugaacaccuggccccacgccaagaacagaaucggccagggccuguacagaaucgacaccagcgacgaggacggcugcagaggccugaacuacggcgugaucugccugggcuucgaccaccugcugagaauggaccuguaccccuucuucaacgccuacgugagccaccugagccugcuggaggccuacaccgagaacaucauccagaaggacgagaccgagugcgagaucgagggcggcaaggaguucaagugcuacgaggagagagccuacaucaagggcgugugcccccacagaaucaagagcgcccacuaccuggaccagaagggcaagcugagaaucaucaagugcaaggagaaccuggagcugaccgaggacugcaccuacugcagaaagaucaagaaggacagaggccacaccaagcagguguacaagaccagcgugccccugcaggacgccaucugccaggacaacagcgacgacuacagcggccccaagaucagcuucaagggcgugugcaagaucggcaugaucgaguacaaggagugcaaguacaagagcagcagcuucgagaccgugggcuucaucaccaucaaggagaagggcaaguucuacaucgaggacaugaagcugaagaaccuggaggugaccaacaacguggccuucaucugccaccaguacaccggccaggacggcaccaccgacgaggagaacagacaccugaagagaaugagcgugaaggacugcaagaacgugaacagcagcaagagcaaguacugcaccggcgaccacaucuucugccagguguacgacugcaccaagagcuaccccgaggccaccugcuucguggcccccggcagcggccccgugcuggugcaggugaugggcagcuggaucaagccccagugcgugggcuacgagaaggugcugguggagagagaggugaagaugcccauccugaccgaggagagagacugcgacaccugcguguacgagugcaaggaggaccacauccugaucaagagcaccggcuucaacaugaucagcgccguggccugcagccacggcagcugcgugagcgcccaccaggaccccagcaccuuccugaacaucgaguaccccggcaugagcgccagcgugggcggcgagaucggcauccacaucagccacaccgacgacagccugagccugcacaagaagaucuacugccccgccagagacagcugcgaggcccacaacugcaucaugugcuaccacggccugaucaacuaccagugccacaccgcccugagcuacgccguggugagcuucauguucgugagcaucgccuacgugaucuucaacgugcugagacuggugcugguggcccugcacguggugcccagaaagcugaagagccccaucgacuggcugauccugcugaucaaguggguguuccugcugcuggccaaggugaucagagccuuccugacccaccugaacaccaccaucggcuggagagagagacagaacaacuucgccgccgaccuggaggcccagagaagaccccugcagagauucaagaccaccgugcugcugaugaugaugcugaucagcguggugagcagcugcagcaacagcguggugagcaacagcaagcagaccagaugcauccagagcggcagcaacaccaagugcagcgugagcgccaccaucacccugaaggccggcgugaucggcgccgagagcugcuucgugaucaagggccccagcgagaaccagcacaagaccaucgugaucagaaccgugagcagcgagaccaucugcagagagggcagcagcuucuggaccggccacuucacccccagcugccugagcagcagaagaugccaccuggugggcgacugcgugggcagcagaugccagggcuggagagaggacgugaucagcagagaguucggcggcgugaaggacaacaaccagaugagcgagaacaagugcuucgagcagugcggcgccgccggcugcggcugcuucaacaucaaccccagcugccuguacgugcacaccauccugagaagcgccagaaacgaggccgugagaguguucaagugcaacgacugggugcacaagcugaccuuccacaucaagggccccaacggcgaggaggaggacguggugcugaacagccugagcaccaaguuccugagcuggggcaccaucagccugagccuggacagcgagggcaucaccggcaccaacagcuacagcuuccuggagagcagcaagggcggcuucgccauccacgacgaggaguucagcgagauccccagagagggcuuccugggcgagaucagaugcagcagcgagagcgccguggugagcgcccacaagagcugcaucagagcccccggccugaucaaguacaagcccaugaccgaccagguggagugcagcgccagccugguggaccccuucgccaucuucaucaagggcagccugccccagaccagaagcggcuacaccuucaccagcagcagagacaagagaaccauccaggccuucaacaacggcgccaucaaggcccugcugacccugaaccuggacgaccacgaggugaucuucagcgagagcgugaucaccugcgagugcaccuuccugaacaucagcggcugcuacagcugcaacuucggcgcccaggugugcuucaagaucaagagcagcggcaucggcgacuucgugagcagcagcgagaccggcaacauccuguucagcuuccccgugaagagcggcaccgaggacuacugccagauccagcacuucaacagccccauggugagcgagagccugcaguacagcugcggcggcgagagcaagcugcugcugaucaagggcagccugaucagcgugggccccuacgacuacagaaacaagaccggcggcagcagcaccguggugaaccccgccgaggacagcuggagcaucuucaacuggcugagcggcuuccuggacuggcugggcggcccccugagagcccuggugaagaucgcccuggccaucaucggcgcccuggcccugcuguucaucaccaucaugcuggccagaagcgugaucagcaacacccugagcagaaagaagaagaacuga

SEQ ID NO: 9447 - RNA, 3594 nt, Artificial Sequence
  derived and/or modified CDS sequence (opt4) from RVFV(ZH-548)__DQ380206.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9448 - RNA, 3594 nt, Artificial Sequence
  derived and/or modified CDS sequence (opt4) from RVFV(ZS-6365)__DQ380205.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9449 - RNA, 3594 nt, Artificial Sequence
  derived and/or modified CDS sequence (opt4) from RVFV(CAR-R1622)__DQ380219.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9450 - RNA, 3594 nt, Artificial Sequence
  derived and/or modified CDS sequence (opt4) from RVFV(2250/74)__DQ380209.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccaaggugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9451 - RNA, 3594 nt, Artificial Sequence
  derived and/or modified CDS sequence (opt4) from RVFV(T1)__DQ380201.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9452 - RNA, 3594 nt, Artificial Sequence
  derived and/or modified CDS sequence (opt4) from RVFV(1853/78)__DQ380220.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9453 - RNA, 3594 nt, Artificial Sequence
  derived and/or modified CDS sequence (opt4) from RVFV(MP-12)__DQ380208.1__GP
auguacgugcugcugaccauccugaccagcgugcuggugugcgaggccaucaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagcugaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcggcaccggccugagcaagauguggcuggccgccaccaagaaggccagcuga

SEQ ID NO: 9454 - RNA, 3594 nt, Artificial Sequence
  derived and/or modified CDS sequence (opt4) from RVFV(ZM-657)__DQ380204.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaaggccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9455 - RNA, 3594 nt, Artificial Sequence
  derived and/or modified CDS sequence (opt4) from RVFV(ZH-501-777)__DQ380202.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggaccccggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9456 - RNA, 3594 nt, Artificial Sequence
  derived and/or modified CDS sequence (opt4) from RVFV(OS-3)__DQ380184.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9457 - RNA, 3594 nt, Artificial Sequence
  derived and/or modified CDS sequence (opt4) from RVFV(Sudan 86-2010)__JQ820489.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugaucuucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9458 - RNA, 3594 nt, Artificial Sequence
  derived and/or modified CDS sequence (opt4) from RVFV(T-46 (228113))__DQ380199.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccaaggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9459 - RNA, 3594 nt, Artificial Sequence
  derived and/or modified CDS sequence (opt4) from RVFV(2007000094)__EU574055.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9460 - RNA, 3594 nt, Artificial Sequence
  derived and/or modified CDS sequence (opt4) from RVFV(ZC-3349)__DQ380207.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccaggccgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccacgugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugaaggcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9461 - RNA, 3594 nt, Artificial Sequence
  derived and/or modified CDS sequence (opt4) from RVFV(2007001602)__EU574043.1__GP
auguacgugcugcugaccauccugaucagcgugcuggugugcgaggccgugaucagagugagcaucagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9462 - RNA, 3594 nt, Artificial Sequence
  derived and/or modified CDS sequence (opt4) from RVFV(1260/78)__DQ380214.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccugcacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9463 - RNA, 3594 nt, Artificial Sequence
  derived and/or modified CDS sequence (opt4) from RVFV(2007000324)__JF326195.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9464 - RNA, 3594 nt, Artificial Sequence
  derived and/or modified CDS sequence (opt4) from RVFV(KEN/Gar-Msq/131B-04/06)__HM586972.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagcuucagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9465 - RNA, 3594 nt, Artificial Sequence
  derived and/or modified CDS sequence (opt4) from RVFV(2007004194)__EU574031.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugagcaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9466 - RNA, 3594 nt, Artificial Sequence
  derived and/or modified CDS sequence (opt4) from RVFV(73HB1230)__DQ380221.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcaggugggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagaaggagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaucaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9467 - RNA, 3594 nt, Artificial Sequence
  derived and/or modified CDS sequence (opt4) from RVFV(73HB1449)__DQ380211.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagaaccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9468 - RNA, 3594 nt, Artificial Sequence
  derived and/or modified CDS sequence (opt4) from RVFV(ZH-548M12)__M25276.1__GP
auguacgugcugcugaccauccugaccagcgugcuggugugcgaggccaucaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagaaagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagcugaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcggcaccggccugagcaagauguggcuggccgccaccaagaaggccagcuga

SEQ ID NO: 9469 - RNA, 3594 nt, Artificial Sequence
  derived and/or modified CDS sequence (opt4) from RVFV(ZINGA J83 R1)__KU978776.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacugaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9470 - RNA, 3594 nt, Artificial Sequence
  derived and/or modified CDS sequence (opt4) from RVFV(Sudan 28-2010)__JQ820491.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggugcugagcaucggccuguucuuccugcugaucuaccugggcagaaccggccugagcaagauguggcuggccgccaccaagaaggccagcuga

SEQ ID NO: 9471 - RNA, 3594 nt, Artificial Sequence
  derived and/or modified CDS sequence (opt4) from RVFV(2007001292)__EU574046.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaaccuguucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9472 - RNA, 3594 nt, Artificial Sequence
  derived and/or modified CDS sequence (opt4) from RVFV(Sudan 85-2010)__JQ820488.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9473 - RNA, 3594 nt, Artificial Sequence
  derived and/or modified CDS sequence (opt4) from RVFV(2007002060)__EU574039.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaaaggacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9474 - RNA, 3594 nt, Artificial Sequence
  derived and/or modified CDS sequence (opt4) from RVFV(2007002476)__EU574036.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucaaguggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9475 - RNA, 3594 nt, Artificial Sequence
  derived and/or modified CDS sequence (opt4) from RVFV(2269/74)__DQ380222.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccagcacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9476 - RNA, 3594 nt, Artificial Sequence
  derived and/or modified CDS sequence (opt4) from RVFV(SA-51 (Van Wyck))__DQ380195.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggcagaggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggaggugaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9477 - RNA, 3594 nt, Artificial Sequence
  derived and/or modified CDS sequence (opt4) from RVFV(OS-8)__DQ380185.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugagaaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugagcggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9478 - RNA, 3594 nt, Artificial Sequence
  derived and/or modified CDS sequence (opt4) from RVFV(BIME-01)__KX609032.1__GP
auguacgugcugcugaccauccugaucagcgugcuggugugcgaggccaucaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9479 - RNA, 3594 nt, Artificial Sequence
  derived and/or modified CDS sequence (opt4) from RVFV(Kenya 83 (21445))__DQ380198.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaagaaccccgagaacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9480 - RNA, 3594 nt, Artificial Sequence
  derived and/or modified CDS sequence (opt4) from RVFV(2007000253)__JF326192.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgccggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9481 - RNA, 3594 nt, Artificial Sequence
  derived and/or modified CDS sequence (opt4) from RVFV(200803166)__JF311381.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcugaagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccaccgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacguggugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9482 - RNA, 3594 nt, Artificial Sequence
  derived and/or modified CDS sequence (opt4) from RVFV(2007001107)__EU574047.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcaaccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9483 - RNA, 3594 nt, Artificial Sequence
  derived and/or modified CDS sequence (opt4) from RVFV(ANK-3837)__DQ380215.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaagcuggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9484 - RNA, 3594 nt, Artificial Sequence
  derived and/or modified CDS sequence (opt4) from RVFV(OS-1)__DQ380186.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagacagagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugaagguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9485 - RNA, 3594 nt, Artificial Sequence
  derived and/or modified CDS sequence (opt4) from RVFV(Sudan 2V-2007)__JQ820490.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugcagcgugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagccacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugauggccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9486 - RNA, 3594 nt, Artificial Sequence
  derived and/or modified CDS sequence (opt4) from RVFV(200803162)__JF311377.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucgccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugagaaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9487 - RNA, 3594 nt, Artificial Sequence
  derived and/or modified CDS sequence (opt4) from RVFV(2007001811)__EU574040.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaugaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9488 - RNA, 3594 nt, Artificial Sequence
  derived and/or modified CDS sequence (opt4) from RVFV(clone 13)__DQ380213.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagcacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagaaccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9489 - RNA, 3594 nt, Artificial Sequence
  derived and/or modified CDS sequence (opt4) from RVFV(MP12)__Z30318.1__GP
auguacgugcugcugaccauccugaccagcgugcuggugugcgaggccaucaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagaaagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggcccacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagcugaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcggcaccggccugagcaagauguggcuggccgccaccaagaaggccagcuga

SEQ ID NO: 9490 - RNA, 3594 nt, Artificial Sequence
  derived and/or modified CDS sequence (opt4) from RVFV__JQ068143.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccaucgacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9491 - RNA, 3594 nt, Artificial Sequence
  derived and/or modified CDS sequence (opt4) from RVFV(2007002445)__EU574037.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcauccaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9492 - RNA, 3594 nt, Artificial Sequence
  derived and/or modified CDS sequence (opt4) from RVFV(2008/00101)__HE687306.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccacccugcugaucugccuguacguggcccugagcaucggccuguucuuccugcugaucuaccugggcagaaccggccugagcaagauguggcuggccgccaccaagaaggccagcuga

SEQ ID NO: 9493 - RNA, 3594 nt, Artificial Sequence
  derived and/or modified CDS sequence (opt4) from RVFV(Hv-B375)__DQ380218.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagagggcgagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagaacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9494 - RNA, 3594 nt, Artificial Sequence
  derived and/or modified CDS sequence (opt4) from RVFV(763/70)__DQ380188.1__GP
auguacgugcugcugaccauccugaucaccgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccuggugaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacggccugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9495 - RNA, 3594 nt, Artificial Sequence
  derived and/or modified CDS sequence (opt4) from RVFV(RVFBJ01/2016)__KX785331.1__GP
auguacgugcugcugaccauccugaucagcgugcuggugugcgaggccaucaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagcacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9496 - RNA, 3594 nt, Artificial Sequence
  derived and/or modified CDS sequence (opt4) from RVFV(Lunyo)__KU167026.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggugagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccagaugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9497 - RNA, 3594 nt, Artificial Sequence
  derived and/or modified CDS sequence (opt4) from RVFV(2007000234)__JF326191.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucagaagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9498 - RNA, 3594 nt, Artificial Sequence
  derived and/or modified CDS sequence (opt4) from RVFV(KEN07-KUR340)__EF460404.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagaaugcugaagugccugaagaucgcccccagaaucgugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9499 - RNA, 3594 nt, Artificial Sequence
  derived and/or modified CDS sequence (opt4) from RVFV(2373/74)__DQ380194.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugcuacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaugguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcacccuggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9500 - RNA, 3594 nt, Artificial Sequence
  derived and/or modified CDS sequence (opt4) from RVFV(200803169)__JF311384.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaagguggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgaggugagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9501 - RNA, 3594 nt, Artificial Sequence
  derived and/or modified CDS sequence (opt4) from RVFV(200803167)__JF311382.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggaccugcaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucgcccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccaugcugcugaucugccuguacguggcccugagcaucggccuguucuuccugcugaucuaccugggcagaaccggccugagcaagauguggcuggccgccaccaagaaggccagcuga

SEQ ID NO: 9502 - RNA, 3594 nt, Artificial Sequence
  derived and/or modified CDS sequence (opt4) from RVFV(Entebbe)__DQ380191.1__GP
auguacgcccugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcugcacagagcccugaaggccaucaucgccgccgacggccugaacaacaucaccugccacggcaaggaccccgaggacaagaucagccugaucaagggccccccccacaagaagagagugggcguggugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9503 - RNA, 3594 nt, Artificial Sequence
  derived and/or modified CDS sequence (opt4) from RVFV(25010-24)__KM210509.1__GP
auguacgugcugcugaccauccugaucagcgugcuggugugcgaggccgugaucagagugagccugagcagcaccagagaggagaccugcuucggcgacagcaccaaccccgagaugaucgagagagccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcaggugggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugaucgugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9504 - RNA, 3594 nt, Artificial Sequence
  derived and/or modified CDS sequence (opt4) from RVFV(Kenya 9800523)__DQ380196.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacaccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugaacgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggagggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9505 - RNA, 3594 nt, Artificial Sequence
  derived and/or modified CDS sequence (opt4) from RVFV(ANK-6087)__DQ380216.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaagcuggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcagcaccaaccugaucgaccccuucgugguguucaagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9506 - RNA, 3594 nt, Artificial Sequence
  derived and/or modified CDS sequence (opt4) from RVFV(SAUDI 200010901)__KU978778.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcggcagaagaagagacaccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9507 - RNA, 3594 nt, Artificial Sequence
  derived and/or modified CDS sequence (opt4) from RVFV(35/74)__JF784387.1__GP
auguacgugcugcugaccauccugaucaccgugcuggugugcgaggccgugaucagagugagccugagcagcaccagagaggagaccugcuucggcgacuacaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccuggugaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcuggacccccugauguggaucaccguguucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9508 - RNA, 3594 nt, Artificial Sequence
  derived and/or modified CDS sequence (opt4) from RVFV(KEN/Kil-006/07)__HM586966.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcguggugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9509 - RNA, 3594 nt, Artificial Sequence
  derived and/or modified CDS sequence (opt4) from RVFV(MgH824)__DQ380210.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggcuacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagagaaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccacccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcguggacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuuccccgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9510 - RNA, 3594 nt, Artificial Sequence
  derived and/or modified CDS sequence (opt4) from RVFV(Kenya 57 (Rintoul))__DQ380192.1__GP
auguacgcccugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcugcacagagcccugaaggccaucaucgccgccgacggccugaacaacaucaccugccacggcaaggaccccgaggacaagaucagccugaucaagggccccccccacaagaagagagugggcguggugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagaucagcagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9511 - RNA, 3594 nt, Artificial Sequence
  derived and/or modified CDS sequence (opt4) from RVFV(SA-75)__DQ380189.1__GP
auguacgugcugcugaccauccugaucaccgugcuggugugcgaggccgugaucagagugagccugagcagcaccagagaggagaccugcuucggcgacuacaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccuggugaagggccccccccacaagaagagagugggcaucgugagaugcgagagaagaagagacgccaagcagaucggcagagagaccauggccagaaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccguguucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9512 - RNA, 3594 nt, Artificial Sequence
  derived and/or modified CDS sequence (opt4) from RVFV(SA01-1322)__KX096942.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcggcagaagaagagacaccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcgaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9513 - RNA, 3594 nt, Artificial Sequence
  derived and/or modified CDS sequence (opt4) from RVFV(KEN/Mal-032/07)__HM586967.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9514 - RNA, 3594 nt, Artificial Sequence
  derived and/or modified CDS sequence (opt4) from RVFV(KEN/Gar-008/06)__HM586965.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcagaguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaaccugaagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgaggugaaggaggaguucauguacagcugcgacggcgacgagagagcccugcugaugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9515 - RNA, 3594 nt, Artificial Sequence
  derived and/or modified CDS sequence (opt4) from RVFV(Kenya 56 (IB8))__DQ380190.1__GP
auguacgugcugcugaccauccugaucaccgugcuggugugcgaggccgugaucagagugagccugagcagcaccagagaggagaccugcuucggcgacagcaccagccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagcaggugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccagggcgacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaaggacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagagaccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaugagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcccgcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucguggccuucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9516 - RNA, 3594 nt, Artificial Sequence
  derived and/or modified CDS sequence (opt4) from RVFV(KEN/Bar-035/07)__HM586969.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccagaagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9517 - RNA, 3594 nt, Artificial Sequence
  derived and/or modified CDS sequence (opt4) from RVFV(TAN/Dod-002/07)__HM586971.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagaaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccaggccuggaucaucagccaguggcacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9518 - RNA, 3594 nt, Artificial Sequence
  derived and/or modified CDS sequence (opt4) from RVFV(Beijing-01)__KX611606.1__GP
auguacgugcugcugaccauccugaucagcgugcugguguucgagguggugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcgugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggcagacugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguguucgacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugauguucgagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9519 - RNA, 3594 nt, Artificial Sequence
  derived and/or modified CDS sequence (opt4) from RVFV(Smithburn)__DQ380193.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaccaucgccgccgacggccugaacaacaucaccugccacggcaaggaccccgaggacaagaucagccugaucaagggccccccccacaagaagagagugggcguggugagaugcgagagacagagagacgccaagcagaucggcagaggcaccauggccggcaucgccaugaccguguuccccgcccuggugguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaucaucaucgccaaggccgacccccccagcugcaaccugcagagcgcccacggcaaccccugcaugaaggagaagcuggugaugaagaccuacugccccaacgacuaccagagcgcccacuaccugaacaacgacggcaagauggccagcgugaagugcccccccaagcacgagcugaccgaggacugcaacuucugcagacagaugaccggcgccagccugaaggagggcagcuacccccugcaggaccuguucugccagagcagcgaggacgacggcagcaagcugaagaccaagaugaagggcgugugcgaggugggcgugcaggugcugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgccuucagcgccuucguggugguguucguguucagcagcguggugaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuucuuccugaucuaccugggcagaaccggccugagcaagauguggcuggccgccaccaagaaggccagcuga

SEQ ID NO: 9520 - RNA, 3594 nt, Artificial Sequence
  derived and/or modified CDS sequence (opt4) from RVFV(KEN/Bar-032/07)__HM586968.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcgugggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagccacaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugagauucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9521 - RNA, 3594 nt, Artificial Sequence
  derived and/or modified CDS sequence (opt4) from RVFV(KEN/Gar-004/06)__HM586964.1__GP
auguacgugcugcugaccauccugaucagcgugugggugugcgaggccgugaucagagugagccugagcagcaccagagaggagaccugcuucggcgacagcaccaaccccgagaugaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagccagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagaaagaagagaaccggcgacgccgccuucugcagcgccuacgagugcaccgcccaguacgccaacgccuacugcagcagagccaacggcagcggcaucgugcagauccaggugagcagaguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacaaccagagccacagcgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugagauucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9522 - RNA, 3621 nt, Artificial Sequence
  derived and/or modified CDS sequence (opt4) from RVFV(RVFV)__M11157.1__GP
auguacgugcugcugaccauccugaucagcgugcuggugugcgaggccgugaucagagugagccugagcagcaccagagaggagaccugcuucggcgacagcaccaaccccgagaugaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacggccugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccacaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggcccacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcaucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccagcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagcuguacagcagcuucgccugcaugcugcacuaccagcugggcagcuucagcagccuguacauccuggaggagcaggccagccugaagugcggccugcugccccugagaagaccccacagaagcgugagagugaaggugaucugcuga

SEQ ID NO: 9523 - RNA, 3480 nt, Artificial Sequence
  derived and/or modified CDS sequence (opt4) from RVFV(ZH-548)__DQ380206.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9524 - RNA, 3480 nt, Artificial Sequence
  derived and/or modified CDS sequence (opt4) from RVFV(ZS-6365)__DQ380205.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9525 - RNA, 3480 nt, Artificial Sequence
  derived and/or modified CDS sequence (opt4) from RVFV(MP-12)__DQ380208.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagcugaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcggcaccggccugagcaagauguggcuggccgccaccaagaaggccagcuga

SEQ ID NO: 9526 - RNA, 3480 nt, Artificial Sequence
  derived and/or modified CDS sequence (opt4) from RVFV(T1)__DQ380201.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9527 - RNA, 3480 nt, Artificial Sequence
  derived and/or modified CDS sequence (opt4) from RVFV(1853/78)__DQ380220.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9528 - RNA, 3480 nt, Artificial Sequence
  derived and/or modified CDS sequence (opt4) from RVFV(CAR-R1622)__DQ380219.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9529 - RNA, 3480 nt, Artificial Sequence
  derived and/or modified CDS sequence (opt4) from RVFV(2250/74)__DQ380209.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccaaggugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9530 - RNA, 3480 nt, Artificial Sequence
  derived and/or modified CDS sequence (opt4) from RVFV(2007000094)__EU574055.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9531 - RNA, 3480 nt, Artificial Sequence
  derived and/or modified CDS sequence (opt4) from RVFV(ZM-657)__DQ380204.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaaggccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9532 - RNA, 3480 nt, Artificial Sequence
  derived and/or modified CDS sequence (opt4) from RVFV(ZH-548M12)__M25276.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagaaagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagcugaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcggcaccggccugagcaagauguggcuggccgccaccaagaaggccagcuga

SEQ ID NO: 9533 - RNA, 3480 nt, Artificial Sequence
  derived and/or modified CDS sequence (opt4) from RVFV(ZH-501-777)__DQ380202.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggaccccggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9534 - RNA, 3480 nt, Artificial Sequence
  derived and/or modified CDS sequence (opt4) from RVFV(T-46 (228113))__DQ380199.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccaaggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9535 - RNA, 3480 nt, Artificial Sequence
  derived and/or modified CDS sequence (opt4) from RVFV(OS-3)__DQ380184.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9536 - RNA, 3480 nt, Artificial Sequence
  derived and/or modified CDS sequence (opt4) from RVFV(Sudan 86-2010)__JQ820489.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugaucuucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9537 - RNA, 3480 nt, Artificial Sequence
  derived and/or modified CDS sequence (opt4) from RVFV(Sudan 28-2010)__JQ820491.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggugcugagcaucggccuguucuuccugcugaucuaccugggcagaaccggccugagcaagauguggcuggccgccaccaagaaggccagcuga

SEQ ID NO: 9538 - RNA, 3480 nt, Artificial Sequence
  derived and/or modified CDS sequence (opt4) from RVFV(2007004194)__EU574031.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugagcaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9539 - RNA, 3480 nt, Artificial Sequence
  derived and/or modified CDS sequence (opt4) from RVFV(73HB1230)__DQ380221.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcaggugggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagaaggagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaucaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9540 - RNA, 3480 nt, Artificial Sequence
  derived and/or modified CDS sequence (opt4) from RVFV(1260/78)__DQ380214.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccugcacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9541 - RNA, 3480 nt, Artificial Sequence
  derived and/or modified CDS sequence (opt4) from RVFV(ZC-3349)__DQ380207.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccaggccgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccacgugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugaaggcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9542 - RNA, 3480 nt, Artificial Sequence
  derived and/or modified CDS sequence (opt4) from RVFV(Sudan 85-2010)__JQ820488.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9543 - RNA, 3480 nt, Artificial Sequence
  derived and/or modified CDS sequence (opt4) from RVFV(2007000324)__JF326195.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9544 - RNA, 3480 nt, Artificial Sequence
  derived and/or modified CDS sequence (opt4) from RVFV(OS-8)__DQ380185.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugagaaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugagcggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9545 - RNA, 3480 nt, Artificial Sequence
  derived and/or modified CDS sequence (opt4) from RVFV(ZINGA J83 R1)__KU978776.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacugaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9546 - RNA, 3480 nt, Artificial Sequence
  derived and/or modified CDS sequence (opt4) from RVFV(2007000253)__JF326192.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgccggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9547 - RNA, 3480 nt, Artificial Sequence
  derived and/or modified CDS sequence (opt4) from RVFV(MP12)__Z30318.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagaaagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggcccacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagcugaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcggcaccggccugagcaagauguggcuggccgccaccaagaaggccagcuga

SEQ ID NO: 9548 - RNA, 3480 nt, Artificial Sequence
  derived and/or modified CDS sequence (opt4) from RVFV(BIME-01)__KX609032.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9549 - RNA, 3480 nt, Artificial Sequence
  derived and/or modified CDS sequence (opt4) from RVFV(200803166)__JF311381.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcugaagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccaccgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacguggugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9550 - RNA, 3480 nt, Artificial Sequence
  derived and/or modified CDS sequence (opt4) from RVFV(Kenya 83 (21445))__DQ380198.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaagaaccccgagaacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9551 - RNA, 3480 nt, Artificial Sequence
  derived and/or modified CDS sequence (opt4) from RVFV(Entebbe)__DQ380191.1__NSm-Gn-Gc
augaucgagggcgccugggacagccugagagaggaggagaugcccgaggagcugagcugcagcaucagcggcaucagagaggugaagaccagcagccaggagcugcacagagcccugaaggccaucaucgccgccgacggccugaacaacaucaccugccacggcaaggaccccgaggacaagaucagccugaucaagggccccccccacaagaagagagugggcguggugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9552 - RNA, 3480 nt, Artificial Sequence
  derived and/or modified CDS sequence (opt4) from RVFV(763/70)__DQ380188.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccuggugaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacggccugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9553 - RNA, 3480 nt, Artificial Sequence
  derived and/or modified CDS sequence (opt4) from RVFV(OS-1)__DQ380186.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagacagagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugaagguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9554 - RNA, 3480 nt, Artificial Sequence
  derived and/or modified CDS sequence (opt4) from RVFV(2008/00101)__HE687306.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccacccugcugaucugccuguacguggcccugagcaucggccuguucuuccugcugaucuaccugggcagaaccggccugagcaagauguggcuggccgccaccaagaaggccagcuga

SEQ ID NO: 9555 - RNA, 3480 nt, Artificial Sequence
  derived and/or modified CDS sequence (opt4) from RVFV(200803162)__JF311377.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucgccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugagaaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9556 - RNA, 3480 nt, Artificial Sequence
  derived and/or modified CDS sequence (opt4) from RVFV(2007002060)__EU574039.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaaaggacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9557 - RNA, 3480 nt, Artificial Sequence
  derived and/or modified CDS sequence (opt4) from RVFV(2007002476)__EU574036.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucaaguggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9558 - RNA, 3480 nt, Artificial Sequence
  derived and/or modified CDS sequence (opt4) from RVFV(2269/74)__DQ380222.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccagcacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9559 - RNA, 3480 nt, Artificial Sequence
  derived and/or modified CDS sequence (opt4) from RVFV(73HB1449)__DQ380211.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagaaccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9560 - RNA, 3480 nt, Artificial Sequence
  derived and/or modified CDS sequence (opt4) from RVFV(SA-51 (Van Wyck))__DQ380195.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggcagaggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggaggugaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9561 - RNA, 3480 nt, Artificial Sequence
  derived and/or modified CDS sequence (opt4) from RVFV(KEN/Gar-Msq/131B-04/06)__HM586972.1__NSm-Gn-Gc
augaucgagggcgccugggacagcuucagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9562 - RNA, 3480 nt, Artificial Sequence
  derived and/or modified CDS sequence (opt4) from RVFV(2007001107)__EU574047.1__NSm-Gn-Gc
augaucgagggcgccugggacagccugagagaggaggagaugcccgaggagcugagcugcagcgugagcggcaucagagaggugaagaccagcaaccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9563 - RNA, 3480 nt, Artificial Sequence
  derived and/or modified CDS sequence (opt4) from RVFV(ANK-3837)__DQ380215.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaagcuggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9564 - RNA, 3480 nt, Artificial Sequence
  derived and/or modified CDS sequence (opt4) from RVFV(Lunyo)__KU167026.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggugagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccagaugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9565 - RNA, 3480 nt, Artificial Sequence
  derived and/or modified CDS sequence (opt4) from RVFV(RVFBJ01/2016)__KX785331.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagcacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9566 - RNA, 3480 nt, Artificial Sequence
  derived and/or modified CDS sequence (opt4) from RVFV(Ken 199800523)__KU978777.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacaccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugaacgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggagggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9567 - RNA, 3480 nt, Artificial Sequence
  derived and/or modified CDS sequence (opt4) from RVFV__JQ068143.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccaucgacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9568 - RNA, 3480 nt, Artificial Sequence
  derived and/or modified CDS sequence (opt4) from RVFV(200803169)__JF311384.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaagguggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgaggugagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9569 - RNA, 3480 nt, Artificial Sequence
  derived and/or modified CDS sequence (opt4) from RVFV(2007002445)__EU574037.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcauccaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9570 - RNA, 3480 nt, Artificial Sequence
  derived and/or modified CDS sequence (opt4) from RVFV(Hv-B375)__DQ380218.1__NSm-Gn-Gc
augaucgagggcgccugggacagccugagagagggcgagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagaacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9571 - RNA, 3480 nt, Artificial Sequence
  derived and/or modified CDS sequence (opt4) from RVFV(clone 13)__DQ380213.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagcacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagaaccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9572 - RNA, 3480 nt, Artificial Sequence
  derived and/or modified CDS sequence (opt4) from RVFV(Kenya 57 (Rintoul))__DQ380192.1__NSm-Gn-Gc
augaucgagggcgccugggacagccugagagaggaggagaugcccgaggagcugagcugcagcaucagcggcaucagagaggugaagaccagcagccaggagcugcacagagcccugaaggccaucaucgccgccgacggccugaacaacaucaccugccacggcaaggaccccgaggacaagaucagccugaucaagggccccccccacaagaagagagugggcguggugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagaucagcagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9573 - RNA, 3480 nt, Artificial Sequence
  derived and/or modified CDS sequence (opt4) from RVFV(2007001292)__EU574046.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaaccuguucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9574 - RNA, 3480 nt, Artificial Sequence
  derived and/or modified CDS sequence (opt4) from RVFV(2007001811)__EU574040.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaugaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9575 - RNA, 3480 nt, Artificial Sequence
  derived and/or modified CDS sequence (opt4) from RVFV(ANK-6087)__DQ380216.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaagcuggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcagcaccaaccugaucgaccccuucgugguguucaagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9576 - RNA, 3480 nt, Artificial Sequence
  derived and/or modified CDS sequence (opt4) from RVFV(2007000234)__JF326191.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucagaagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9577 - RNA, 3480 nt, Artificial Sequence
  derived and/or modified CDS sequence (opt4) from RVFV(SA-75)__DQ380189.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccuggugaagggccccccccacaagaagagagugggcaucgugagaugcgagagaagaagagacgccaagcagaucggcagagagaccauggccagaaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccguguucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9578 - RNA, 3480 nt, Artificial Sequence
  derived and/or modified CDS sequence (opt4) from RVFV(KEN07-KUR340)__EF460404.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagaaugcugaagugccugaagaucgcccccagaaucgugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9579 - RNA, 3480 nt, Artificial Sequence
  derived and/or modified CDS sequence (opt4) from RVFV(35/74)__JF784387.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccuggugaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcuggacccccugauguggaucaccguguucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9580 - RNA, 3480 nt, Artificial Sequence
  derived and/or modified CDS sequence (opt4) from RVFV(200803167)__JF311382.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggaccugcaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucgcccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccaugcugcugaucugccuguacguggcccugagcaucggccuguucuuccugcugaucuaccugggcagaaccggccugagcaagauguggcuggccgccaccaagaaggccagcuga

SEQ ID NO: 9581 - RNA, 3480 nt, Artificial Sequence
  derived and/or modified CDS sequence (opt4) from RVFV(25010-24)__KM210509.1__NSm-Gn-Gc
augaucgagagagccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcaggugggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugaucgugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9582 - RNA, 3480 nt, Artificial Sequence
  derived and/or modified CDS sequence (opt4) from RVFV(Sudan 2V-2007)__JQ820490.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugcagcgugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagccacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugauggccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9583 - RNA, 3480 nt, Artificial Sequence
  derived and/or modified CDS sequence (opt4) from RVFV(SAUDI 200010901)__KU978778.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcggcagaagaagagacaccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9584 - RNA, 3480 nt, Artificial Sequence
  derived and/or modified CDS sequence (opt4) from RVFV(2373/74)__DQ380194.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugcuacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaugguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcacccuggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9585 - RNA, 3480 nt, Artificial Sequence
  derived and/or modified CDS sequence (opt4) from RVFV(KEN/Kil-006/07)__HM586966.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcguggugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9586 - RNA, 3480 nt, Artificial Sequence
  derived and/or modified CDS sequence (opt4) from RVFV(MgH824)__DQ380210.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggcuacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagagaaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccacccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcguggacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuuccccgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9587 - RNA, 3480 nt, Artificial Sequence
  derived and/or modified CDS sequence (opt4) from RVFV(SA01-1322)__KX096942.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcggcagaagaagagacaccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcgaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9588 - RNA, 3480 nt, Artificial Sequence
  derived and/or modified CDS sequence (opt4) from RVFV(Kenya 56 (IB8))__DQ380190.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagcaggugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccagggcgacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaaggacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagagaccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaugagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcccgcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucguggccuucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9589 - RNA, 3480 nt, Artificial Sequence
  derived and/or modified CDS sequence (opt4) from RVFV(KEN/Mal-032/07)__HM586967.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9590 - RNA, 3480 nt, Artificial Sequence
  derived and/or modified CDS sequence (opt4) from RVFV(KEN/Gar-008/06)__HM586965.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcagaguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaaccugaagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgaggugaaggaggaguucauguacagcugcgacggcgacgagagagcccugcugaugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9591 - RNA, 3480 nt, Artificial Sequence
  derived and/or modified CDS sequence (opt4) from RVFV(Beijing-01)__KX611606.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaucaucgccgccgacggccugaacaacaucaccugccacggcaaggaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcgugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggcagacugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguguucgacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugauguucgagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9592 - RNA, 3480 nt, Artificial Sequence
  derived and/or modified CDS sequence (opt4) from RVFV(KEN/Bar-035/07)__HM586969.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccagaagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9593 - RNA, 3480 nt, Artificial Sequence
  derived and/or modified CDS sequence (opt4) from RVFV(KEN/Bar-032/07)__HM586968.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcgugggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagccacaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugagauucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9594 - RNA, 3480 nt, Artificial Sequence
  derived and/or modified CDS sequence (opt4) from RVFV(TAN/Dod-002/07)__HM586971.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagaaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccaggccuggaucaucagccaguggcacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9595 - RNA, 3480 nt, Artificial Sequence
  derived and/or modified CDS sequence (opt4) from RVFV(Smithburn)__DQ380193.1__NSm-Gn-Gc
augaucgagggcgccugggacagccugagagaggaggagaugcccgaggagcugagcugcagcaucagcggcaucagagaggugaagaccagcagccaggagcuguacagagcccugaaggccaccaucgccgccgacggccugaacaacaucaccugccacggcaaggaccccgaggacaagaucagccugaucaagggccccccccacaagaagagagugggcguggugagaugcgagagacagagagacgccaagcagaucggcagaggcaccauggccggcaucgccaugaccguguuccccgcccuggugguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaucaucaucgccaaggccgacccccccagcugcaaccugcagagcgcccacggcaaccccugcaugaaggagaagcuggugaugaagaccuacugccccaacgacuaccagagcgcccacuaccugaacaacgacggcaagauggccagcgugaagugcccccccaagcacgagcugaccgaggacugcaacuucugcagacagaugaccggcgccagccugaaggagggcagcuacccccugcaggaccuguucugccagagcagcgaggacgacggcagcaagcugaagaccaagaugaagggcgugugcgaggugggcgugcaggugcugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgccuucagcgccuucguggugguguucguguucagcagcguggugaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuucuuccugaucuaccugggcagaaccggccugagcaagauguggcuggccgccaccaagaaggccagcuga

SEQ ID NO: 9596 - RNA, 3480 nt, Artificial Sequence
  derived and/or modified CDS sequence (opt4) from RVFV(KEN/Gar-004/06)__HM586964.1__NSm-Gn-Gc
augaucgagggcgccugggacagccugagagaggaggagaugcccgaggagcugagcugcagcgugagcggcaucagagaggugaagaccagcagccaggagcuguacagagcccugaaggccaucaucgccgccgacggccugaacaacaucaccugccacggcaagaaccccgaggacaagaucagccugaucaagggccccccccacaagaagagagugggcaucgugagaugcgagagaagaagagacgccaagcagaucggcagagagaccauggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagccagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagaaagaagagaaccggcgacgccgccuucugcagcgccuacgagugcaccgcccaguacgccaacgccuacugcagcagagccaacggcagcggcaucgugcagauccaggugagcagaguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacaaccagagccacagcgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugagauucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9597 - RNA, 3204 nt, Artificial Sequence
  derived and/or modified CDS sequence (opt4) from RVFV(ZH-548)__DQ380206.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9598 - RNA, 3204 nt, Artificial Sequence
  derived and/or modified CDS sequence (opt4) from RVFV(2007000094)__EU574055.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9599 - RNA, 3204 nt, Artificial Sequence
  derived and/or modified CDS sequence (opt4) from RVFV(ZH-548M12)__M25276.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagcugaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcggcaccggccugagcaagauguggcuggccgccaccaagaaggccagcuga

SEQ ID NO: 9600 - RNA, 3204 nt, Artificial Sequence
  derived and/or modified CDS sequence (opt4) from RVFV(Sudan 86-2010)__JQ820489.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugaucuucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9601 - RNA, 3204 nt, Artificial Sequence
  derived and/or modified CDS sequence (opt4) from RVFV(ZS-6365)__DQ380205.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9602 - RNA, 3204 nt, Artificial Sequence
  derived and/or modified CDS sequence (opt4) from RVFV(1853/78)__DQ380220.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9603 - RNA, 3204 nt, Artificial Sequence
  derived and/or modified CDS sequence (opt4) from RVFV(T1)__DQ380201.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9604 - RNA, 3204 nt, Artificial Sequence
  derived and/or modified CDS sequence (opt4) from RVFV(Kenya 83 (21445))__DQ380198.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9605 - RNA, 3204 nt, Artificial Sequence
  derived and/or modified CDS sequence (opt4) from RVFV(Sudan 85-2010)__JQ820488.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9606 - RNA, 3204 nt, Artificial Sequence
  derived and/or modified CDS sequence (opt4) from RVFV(2007004194)__EU574031.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugagcaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9607 - RNA, 3204 nt, Artificial Sequence
  derived and/or modified CDS sequence (opt4) from RVFV(2250/74)__DQ380209.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccaaggugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9608 - RNA, 3204 nt, Artificial Sequence
  derived and/or modified CDS sequence (opt4) from RVFV(Sudan 28-2010)__JQ820491.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggugcugagcaucggccuguucuuccugcugaucuaccugggcagaaccggccugagcaagauguggcuggccgccaccaagaaggccagcuga

SEQ ID NO: 9609 - RNA, 3204 nt, Artificial Sequence
  derived and/or modified CDS sequence (opt4) from RVFV(2007000324)__JF326195.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9610 - RNA, 3204 nt, Artificial Sequence
  derived and/or modified CDS sequence (opt4) from RVFV(ZM-657)__DQ380204.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaaggccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9611 - RNA, 3204 nt, Artificial Sequence
  derived and/or modified CDS sequence (opt4) from RVFV(T-46 (228113))__DQ380199.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccaaggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9612 - RNA, 3204 nt, Artificial Sequence
  derived and/or modified CDS sequence (opt4) from RVFV(MP12)__Z30318.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggcccacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagcugaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcggcaccggccugagcaagauguggcuggccgccaccaagaaggccagcuga

SEQ ID NO: 9613 - RNA, 3204 nt, Artificial Sequence
  derived and/or modified CDS sequence (opt4) from RVFV(200803166)__JF311381.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcugaagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccaccgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacguggugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9614 - RNA, 3204 nt, Artificial Sequence
  derived and/or modified CDS sequence (opt4) from RVFV(200803162)__JF311377.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucgccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugagaaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9615 - RNA, 3204 nt, Artificial Sequence
  derived and/or modified CDS sequence (opt4) from RVFV(Hv-B375)__DQ380218.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagaacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9616 - RNA, 3204 nt, Artificial Sequence
  derived and/or modified CDS sequence (opt4) from RVFV(1260/78)__DQ380214.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccugcacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9617 - RNA, 3204 nt, Artificial Sequence
  derived and/or modified CDS sequence (opt4) from RVFV(ZH-501-777)__DQ380202.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggaccccggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9618 - RNA, 3204 nt, Artificial Sequence
  derived and/or modified CDS sequence (opt4) from RVFV(OS-3)__DQ380184.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9619 - RNA, 3204 nt, Artificial Sequence
  derived and/or modified CDS sequence (opt4) from RVFV(SAUDI 200010901)__KU978778.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9620 - RNA, 3204 nt, Artificial Sequence
  derived and/or modified CDS sequence (opt4) from RVFV(2007001811)__EU574040.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaugaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9621 - RNA, 3204 nt, Artificial Sequence
  derived and/or modified CDS sequence (opt4) from RVFV(2007000253)__JF326192.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgccggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9622 - RNA, 3204 nt, Artificial Sequence
  derived and/or modified CDS sequence (opt4) from RVFV(2007001292)__EU574046.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaaccuguucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9623 - RNA, 3204 nt, Artificial Sequence
  derived and/or modified CDS sequence (opt4) from RVFV(2007002476)__EU574036.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucaaguggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9624 - RNA, 3204 nt, Artificial Sequence
  derived and/or modified CDS sequence (opt4) from RVFV(73HB1230)__DQ380221.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagaaggagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaucaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9625 - RNA, 3204 nt, Artificial Sequence
  derived and/or modified CDS sequence (opt4) from RVFV(ZINGA J83 R1)__KU978776.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacugaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9626 - RNA, 3204 nt, Artificial Sequence
  derived and/or modified CDS sequence (opt4) from RVFV(2008/00101)__HE687306.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccacccugcugaucugccuguacguggcccugagcaucggccuguucuuccugcugaucuaccugggcagaaccggccugagcaagauguggcuggccgccaccaagaaggccagcuga

SEQ ID NO: 9627 - RNA, 3204 nt, Artificial Sequence
  derived and/or modified CDS sequence (opt4) from RVFV(2007002445)__EU574037.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcauccaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9628 - RNA, 3204 nt, Artificial Sequence
  derived and/or modified CDS sequence (opt4) from RVFV(ZC-3349)__DQ380207.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccaggccgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccacgugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugaaggcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9629 - RNA, 3204 nt, Artificial Sequence
  derived and/or modified CDS sequence (opt4) from RVFV(Kenya 9800523)__DQ380196.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugaacgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggagggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9630 - RNA, 3204 nt, Artificial Sequence
  derived and/or modified CDS sequence (opt4) from RVFV(Entebbe)__DQ380191.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9631 - RNA, 3204 nt, Artificial Sequence
  derived and/or modified CDS sequence (opt4) from RVFV(25010-24)__KM210509.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugaucgugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9632 - RNA, 3204 nt, Artificial Sequence
  derived and/or modified CDS sequence (opt4) from RVFV(763/70)__DQ380188.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacggccugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9633 - RNA, 3204 nt, Artificial Sequence
  derived and/or modified CDS sequence (opt4) from RVFV(OS-1)__DQ380186.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugaagguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9634 - RNA, 3204 nt, Artificial Sequence
  derived and/or modified CDS sequence (opt4) from RVFV(BIME-01)__KX609032.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9635 - RNA, 3204 nt, Artificial Sequence
  derived and/or modified CDS sequence (opt4) from RVFV(73HB1449)__DQ380211.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagaaccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9636 - RNA, 3204 nt, Artificial Sequence
  derived and/or modified CDS sequence (opt4) from RVFV(SA01-1322)__KX096942.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcgaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9637 - RNA, 3204 nt, Artificial Sequence
  derived and/or modified CDS sequence (opt4) from RVFV(Sudan 2V-2007)__JQ820490.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugcagcgugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagccacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugauggccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9638 - RNA, 3204 nt, Artificial Sequence
  derived and/or modified CDS sequence (opt4) from RVFV(35/74)__JF784387.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcuggacccccugauguggaucaccguguucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9639 - RNA, 3204 nt, Artificial Sequence
  derived and/or modified CDS sequence (opt4) from RVFV(200803169)__JF311384.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaagguggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgaggugagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9640 - RNA, 3204 nt, Artificial Sequence
  derived and/or modified CDS sequence (opt4) from RVFV(2269/74)__DQ380222.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccagcacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9641 - RNA, 3204 nt, Artificial Sequence
  derived and/or modified CDS sequence (opt4) from RVFV(SA-51 (Van Wyck))__DQ380195.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggcagaggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggaggugaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9642 - RNA, 3204 nt, Artificial Sequence
  derived and/or modified CDS sequence (opt4) from RVFV(OS-8)__DQ380185.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugagaaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugagcggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9643 - RNA, 3204 nt, Artificial Sequence
  derived and/or modified CDS sequence (opt4) from RVFV(KEN07-KUR340)__EF460404.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagaaugcugaagugccugaagaucgcccccagaaucgugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9644 - RNA, 3204 nt, Artificial Sequence
  derived and/or modified CDS sequence (opt4) from RVFV(ANK-3837)__DQ380215.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaagcuggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9645 - RNA, 3204 nt, Artificial Sequence
  derived and/or modified CDS sequence (opt4) from RVFV(Lunyo)__KU167026.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggugagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccagaugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9646 - RNA, 3204 nt, Artificial Sequence
  derived and/or modified CDS sequence (opt4) from RVFV(200803167)__JF311382.1__Gn-Gc
auggccggcaucgccaugaccgugcugcccgcccuggccguguucgcccuggcccccgugguguucgccgaggaccugcaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucgcccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccaugcugcugaucugccuguacguggcccugagcaucggccuguucuuccugcugaucuaccugggcagaaccggccugagcaagauguggcuggccgccaccaagaaggccagcuga

SEQ ID NO: 9647 - RNA, 3204 nt, Artificial Sequence
  derived and/or modified CDS sequence (opt4) from RVFV(2373/74)__DQ380194.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaugguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcacccuggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9648 - RNA, 3204 nt, Artificial Sequence
  derived and/or modified CDS sequence (opt4) from RVFV(Kenya 57 (Rintoul))__DQ380192.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagaucagcagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9649 - RNA, 3204 nt, Artificial Sequence
  derived and/or modified CDS sequence (opt4) from RVFV(RVFBJ01/2016)__KX785331.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagcacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9650 - RNA, 3204 nt, Artificial Sequence
  derived and/or modified CDS sequence (opt4) from RVFV(clone 13)__DQ380213.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagcacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagaaccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9651 - RNA, 3204 nt, Artificial Sequence
  derived and/or modified CDS sequence (opt4) from RVFV__JQ068143.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccaucgacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9652 - RNA, 3204 nt, Artificial Sequence
  derived and/or modified CDS sequence (opt4) from RVFV(SA-75)__DQ380189.1__Gn-Gc
auggccagaaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccguguucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9653 - RNA, 3204 nt, Artificial Sequence
  derived and/or modified CDS sequence (opt4) from RVFV(ANK-6087)__DQ380216.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaagcuggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcagcaccaaccugaucgaccccuucgugguguucaagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9654 - RNA, 3204 nt, Artificial Sequence
  derived and/or modified CDS sequence (opt4) from RVFV(KEN/Kil-006/07)__HM586966.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9655 - RNA, 3204 nt, Artificial Sequence
  derived and/or modified CDS sequence (opt4) from RVFV(MgH824)__DQ380210.1__Gn-Gc
auggccggcaucgccaugaccgugcugcccgcccuggccguguucgcccuggcccccgugguguucgccgaggacccccaccugagaaacagacccggcaagggcuacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagagaaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccacccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcguggacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuuccccgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9656 - RNA, 3204 nt, Artificial Sequence
  derived and/or modified CDS sequence (opt4) from RVFV(KEN/Mal-032/07)__HM586967.1__Gn-Gc
auggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9657 - RNA, 3204 nt, Artificial Sequence
  derived and/or modified CDS sequence (opt4) from RVFV(Kenya 56 (IB8))__DQ380190.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccagggcgacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaaggacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagagaccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaugagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcccgcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucguggccuucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9658 - RNA, 3204 nt, Artificial Sequence
  derived and/or modified CDS sequence (opt4) from RVFV(KEN/Gar-008/06)__HM586965.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcagaguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaaccugaagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgaggugaaggaggaguucauguacagcugcgacggcgacgagagagcccugcugaugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9659 - RNA, 3204 nt, Artificial Sequence
  derived and/or modified CDS sequence (opt4) from RVFV(KEN/Bar-035/07)__HM586969.1__Gn-Gc
auggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccagaagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9660 - RNA, 3204 nt, Artificial Sequence
  derived and/or modified CDS sequence (opt4) from RVFV(Smithburn)__DQ380193.1__Gn-Gc
auggccggcaucgccaugaccguguuccccgcccuggugguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaucaucaucgccaaggccgacccccccagcugcaaccugcagagcgcccacggcaaccccugcaugaaggagaagcuggugaugaagaccuacugccccaacgacuaccagagcgcccacuaccugaacaacgacggcaagauggccagcgugaagugcccccccaagcacgagcugaccgaggacugcaacuucugcagacagaugaccggcgccagccugaaggagggcagcuacccccugcaggaccuguucugccagagcagcgaggacgacggcagcaagcugaagaccaagaugaagggcgugugcgaggugggcgugcaggugcugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgccuucagcgccuucguggugguguucguguucagcagcguggugaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuucuuccugaucuaccugggcagaaccggccugagcaagauguggcuggccgccaccaagaaggccagcuga

SEQ ID NO: 9661 - RNA, 3204 nt, Artificial Sequence
  derived and/or modified CDS sequence (opt4) from RVFV(Beijing-01)__KX611606.1__Gn-Gc
auggccggcaucgccaugaccgugcugcccgcccuggccguguucgcccuggcccccgugguguucgccgaggacccccaccugagaaacagacccggcaagggccacaacuacaucgacggcgugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggcagacugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguguucgacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugauguucgagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9662 - RNA, 3204 nt, Artificial Sequence
  derived and/or modified CDS sequence (opt4) from RVFV(KEN/Bar-032/07)__HM586968.1__Gn-Gc
auggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcgugggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagccacaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugagauucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9663 - RNA, 3204 nt, Artificial Sequence
  derived and/or modified CDS sequence (opt4) from RVFV(TAN/Dod-002/07)__HM586971.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagaaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccaggccuggaucaucagccaguggcacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9664 - RNA, 3204 nt, Artificial Sequence
  derived and/or modified CDS sequence (opt4) from RVFV(KEN/Gar-004/06)__HM586964.1__Gn-Gc
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagccagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagaaagaagagaaccggcgacgccgccuucugcagcgccuacgagugcaccgcccaguacgccaacgccuacugcagcagagccaacggcagcggcaucgugcagauccaggugagcagaguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacaaccagagccacagcgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgccugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugagauucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagcuga

SEQ ID NO: 9665 - RNA, 1680 nt, Artificial Sequence
  derived and/or modified CDS sequence (opt4) from RVFV(ZH-548)__DQ380206.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9666 - RNA, 1680 nt, Artificial Sequence
  derived and/or modified CDS sequence (opt4) from RVFV(MP-12)__DQ380208.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9667 - RNA, 1680 nt, Artificial Sequence
  derived and/or modified CDS sequence (opt4) from RVFV(MP12)__Z30318.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcugagcgcccacggcaaccccugcaugaaggagaagcuggugaugaagacccacugccccaacgacuaccagagcgcccaccaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggcccacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9668 - RNA, 1680 nt, Artificial Sequence
  derived and/or modified CDS sequence (opt4) from RVFV(2007001811)__EU574040.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9669 - RNA, 1680 nt, Artificial Sequence
  derived and/or modified CDS sequence (opt4) from RVFV(2250/74)__DQ380209.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9670 - RNA, 1680 nt, Artificial Sequence
  derived and/or modified CDS sequence (opt4) from RVFV(T1)__DQ380201.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9671 - RNA, 1680 nt, Artificial Sequence
  derived and/or modified CDS sequence (opt4) from RVFV(Ken 199800523)__KU978777.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9672 - RNA, 1680 nt, Artificial Sequence
  derived and/or modified CDS sequence (opt4) from RVFV(1853/78)__DQ380220.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9673 - RNA, 1680 nt, Artificial Sequence
  derived and/or modified CDS sequence (opt4) from RVFV(73HB1449)__DQ380211.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagaaccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9674 - RNA, 1680 nt, Artificial Sequence
  derived and/or modified CDS sequence (opt4) from RVFV(2007000234)__JF326191.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9675 - RNA, 1680 nt, Artificial Sequence
  derived and/or modified CDS sequence (opt4) from RVFV(73HB1230)__DQ380221.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagaaggagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9676 - RNA, 1680 nt, Artificial Sequence
  derived and/or modified CDS sequence (opt4) from RVFV(ZM-657)__DQ380204.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaaggccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9677 - RNA, 1680 nt, Artificial Sequence
  derived and/or modified CDS sequence (opt4) from RVFV(Kenya 83 (21445))__DQ380198.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9678 - RNA, 1680 nt, Artificial Sequence
  derived and/or modified CDS sequence (opt4) from RVFV(SAUDI 200010901)__KU978778.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucaucagcuacgccagcgcc

SEQ ID NO: 9679 - RNA, 1680 nt, Artificial Sequence
  derived and/or modified CDS sequence (opt4) from RVFV(2007004194)__EU574031.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugagcaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9680 - RNA, 1680 nt, Artificial Sequence
  derived and/or modified CDS sequence (opt4) from RVFV(ZH-501-777)__DQ380202.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggaccccggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9681 - RNA, 1680 nt, Artificial Sequence
  derived and/or modified CDS sequence (opt4) from RVFV(ZC-3349)__DQ380207.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccaggccgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccacgugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9682 - RNA, 1680 nt, Artificial Sequence
  derived and/or modified CDS sequence (opt4) from RVFV(200803166)__JF311381.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcugaagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccaccgcc

SEQ ID NO: 9683 - RNA, 1680 nt, Artificial Sequence
  derived and/or modified CDS sequence (opt4) from RVFV(1260/78)__DQ380214.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccugcacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9684 - RNA, 1680 nt, Artificial Sequence
  derived and/or modified CDS sequence (opt4) from RVFV(T-46 (228113))__DQ380199.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccaaggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9685 - RNA, 1680 nt, Artificial Sequence
  derived and/or modified CDS sequence (opt4) from RVFV(ZINGA J83 R1)__KU978776.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacugaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgcc

SEQ ID NO: 9686 - RNA, 1680 nt, Artificial Sequence
  derived and/or modified CDS sequence (opt4) from RVFV(clone 13)__DQ380213.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagcacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagaaccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9687 - RNA, 1680 nt, Artificial Sequence
  derived and/or modified CDS sequence (opt4) from RVFV(SA01-1322)__KX096942.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuucugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcgaccccgcccccauccccagacacgcccccauccccagauacagcaccuaccugaugcugcugcugaucaucagcuacgccagcgcc

SEQ ID NO: 9688 - RNA, 1680 nt, Artificial Sequence
  derived and/or modified CDS sequence (opt4) from RVFV(25010-24)__KM210509.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugaucgugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9689 - RNA, 1680 nt, Artificial Sequence
  derived and/or modified CDS sequence (opt4) from RVFV(200803162)__JF311377.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucgccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacgacugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugagaaaccccgcccccauccccagacacgcccccauccccagauacagcaccuaccugaugcugcugcugaucgugagcuacgccagcgcc

SEQ ID NO: 9690 - RNA, 1680 nt, Artificial Sequence
  derived and/or modified CDS sequence (opt4) from RVFV(2007002476)__EU574036.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucaaguggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9691 - RNA, 1680 nt, Artificial Sequence
  derived and/or modified CDS sequence (opt4) from RVFV(Hv-B375)__DQ380218.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagaacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9692 - RNA, 1680 nt, Artificial Sequence
  derived and/or modified CDS sequence (opt4) from RVFV(OS-1)__DQ380186.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9693 - RNA, 1680 nt, Artificial Sequence
  derived and/or modified CDS sequence (opt4) from RVFV(2373/74)__DQ380194.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaugguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9694 - RNA, 1680 nt, Artificial Sequence
  derived and/or modified CDS sequence (opt4) from RVFV(Kenya 57 (Rintoul))__DQ380192.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9695 - RNA, 1680 nt, Artificial Sequence
  derived and/or modified CDS sequence (opt4) from RVFV(Sudan 2V-2007)__JQ820490.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugcagcgugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagccacgccagcgcc

SEQ ID NO: 9696 - RNA, 1680 nt, Artificial Sequence
  derived and/or modified CDS sequence (opt4) from RVFV(200803167)__JF311382.1__Gn
auggccggcaucgccaugaccgugcugcccgcccuggccguguucgcccuggcccccgugguguucgccgaggaccugcaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucgcccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9697 - RNA, 1680 nt, Artificial Sequence
  derived and/or modified CDS sequence (opt4) from RVFV(KEN/Gar-008/06)__HM586965.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcagaguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9698 - RNA, 1680 nt, Artificial Sequence
  derived and/or modified CDS sequence (opt4) from RVFV(ANK-6087)__DQ380216.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaagcuggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggguguacagaaagaugguggccagaguggccgacaacaucaaccaggugaacagagagaucggcuggauggagggcggccagcuggugcugggcaaccccgcccccauccccagacacgugcccauccccagauacagcaccuaccugaugcugcugcugaucgugagcuacgccagcgcc

SEQ ID NO: 9699 - RNA, 1680 nt, Artificial Sequence
  derived and/or modified CDS sequence (opt4) from RVFV(763/70)__DQ380188.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacggccugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9700 - RNA, 1680 nt, Artificial Sequence
  derived and/or modified CDS sequence (opt4) from RVFV(BIME-01)__KX609032.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgcc

SEQ ID NO: 9701 - RNA, 1680 nt, Artificial Sequence
  derived and/or modified CDS sequence (opt4) from RVFV(KEN07-KUR340)__EF460404.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagaaugcugaagugccugaagaucgcccccagaaucgugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9702 - RNA, 1680 nt, Artificial Sequence
  derived and/or modified CDS sequence (opt4) from RVFV(SA-51 (Van Wyck))__DQ380195.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggcagaggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9703 - RNA, 1680 nt, Artificial Sequence
  derived and/or modified CDS sequence (opt4) from RVFV(Lunyo)__KU167026.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggugagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9704 - RNA, 1680 nt, Artificial Sequence
  derived and/or modified CDS sequence (opt4) from RVFV(2269/74)__DQ380222.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccagcacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9705 - RNA, 1680 nt, Artificial Sequence
  derived and/or modified CDS sequence (opt4) from RVFV(MgH824)__DQ380210.1__Gn
auggccggcaucgccaugaccgugcugcccgcccuggccguguucgcccuggcccccgugguguucgccgaggacccccaccugagaaacagacccggcaagggcuacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagagaaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccacccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccauccuguacagagugcugaagugccugaagaucgcccccagaaaggugcugaacccccugauguggaucaccgccuucaucagauggaucuacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9706 - RNA, 1680 nt, Artificial Sequence
  derived and/or modified CDS sequence (opt4) from RVFV__JQ068143.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccaucgacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgcc

SEQ ID NO: 9707 - RNA, 1680 nt, Artificial Sequence
  derived and/or modified CDS sequence (opt4) from RVFV(RVFBJ01/2016)__KX785331.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaagcacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgcc

SEQ ID NO: 9708 - RNA, 1680 nt, Artificial Sequence
  derived and/or modified CDS sequence (opt4) from RVFV(KEN/Kil-006/07)__HM586966.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9709 - RNA, 1680 nt, Artificial Sequence
  derived and/or modified CDS sequence (opt4) from RVFV(SA-75)__DQ380189.1__Gn
auggccagaaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccguguucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9710 - RNA, 1680 nt, Artificial Sequence
  derived and/or modified CDS sequence (opt4) from RVFV(35/74)__JF784387.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcguggugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcuggacccccugauguggaucaccguguucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9711 - RNA, 1680 nt, Artificial Sequence
  derived and/or modified CDS sequence (opt4) from RVFV__M11157.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacggccugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccacaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcaucgccaucaucugccuggccgugcuguacagagugcugaagugccugaagaucgcccccagaaaggugcugaacccccugauguggaucaccgccuucaucagauggaucuacaagaagaugguggccagaguggcccacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9712 - RNA, 1680 nt, Artificial Sequence
  derived and/or modified CDS sequence (opt4) from RVFV(KEN/Bar-035/07)__HM586969.1__Gn
auggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9713 - RNA, 1680 nt, Artificial Sequence
  derived and/or modified CDS sequence (opt4) from RVFV(Kenya 56 (IB8))__DQ380190.1__Gn
auggccggcaucgccaugaccgugcugcccgcccuggccguguucgcccuggcccccgugguguucgccgaggacccccaccugagaaacagacccggcaagggccacaacuacaucgacggcaugacccagggcgacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaaggacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagagaccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaugagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcccgcccugggcaaccccgcccccauccccagacacgcccccauccccagauacagcaccuaccugaugcugcugcugaucgugagcuacgccagcgcc

SEQ ID NO: 9714 - RNA, 1680 nt, Artificial Sequence
  derived and/or modified CDS sequence (opt4) from RVFV(KEN/Bar-032/07)__HM586968.1__Gn
auggccggcaucgccaugaccgugcugcccgcccuggccguguucgcccuggcccccgugguguucgccgaggacccccaccugagaaacagacccggcaagggccacaacuacaucgacggcagacugcaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgccgacggcaacaagugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcgugggcgacaucggcgugcacauggcccacgacgaccagagcgugagcagcaagaucguggcccacugccccccccaggaccccugccuggugcacggcugcaucgugugcgcccacggccugaucaacuaccagugccacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9715 - RNA, 1680 nt, Artificial Sequence
  derived and/or modified CDS sequence (opt4) from RVFV(Beijing-01)__KX611606.1__Gn
auggccggcaucgccaugaccgugcugcccgcccuggccguguucgcccuggcccccgugguguucgccgaggacccccaccugagaaacagacccggcaagggccacaacuacaucgacggcgugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggcagacugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguguucgacugccccccccaggaccccugccuggugcacggcugcaucgugugcgcccacggccugaucaacuaccagugccacaccgcccugagcgccuucguggugguguucguguucagcagcguggccaucaucugccuggccauccuguacaaggugcugagaugccugaagaucgcccccaagaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucaucagcuacgccagcgcc

SEQ ID NO: 9716 - RNA, 1680 nt, Artificial Sequence
  derived and/or modified CDS sequence (opt4) from RVFV(Smithburn)__DQ380193.1__Gn
auggccggcaucgccaugaccguguuccccgcccuggugguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaucaucaucgccaaggccgacccccccagcugcaaccugcagagcgcccacggcaaccccugcaugaaggagaagcuggugaugaagaccuacugccccaacgacuaccagagcgcccacuaccugaacaacgacggcaagauggccagcgugaagugcccccccaagcacgagcugaccgaggacugcaacuucugcagacagaugaccggcgccagccugaaggagggcagcuacccccugcaggaccuguucugccagagcagcgaggacgacggcagcaagcugaagaccaagaugaagggcgugugcgaggugggcgugcaggugcugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaucaagagagagcugaagagcuucgacaucagccagugccccaagaucggcggccacggcagcaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacuaccagugccacaccgccuucagcgccuucguggugguguucguguucagcagcguggugaucaucugccuggccauccuguacaaggugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggugcugggcaaccccgcccccauccccagacacgcccccauccccagauacagcaccuaccugaugcugcugcugaucgugagcuacgccagcgcc

SEQ ID NO: 9717 - RNA, 1680 nt, Artificial Sequence
  derived and/or modified CDS sequence (opt4) from RVFV(TAN/Dod-002/07)__HM586971.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagcaagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagaaagaagugcaccggcgacgccgccuucugcagcgccuacgagugcaccgcccaguacgccaacgccuacugcagccacgccaacggcagcggcaucgugcagauccaggugagcggcguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccaggccuggaucaucagccaguggcacaccgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9718 - RNA, 1680 nt, Artificial Sequence
  derived and/or modified CDS sequence (opt4) from RVFV(KEN/Gar-004/06)__HM586964.1__Gn
auggccggcaucgccaugaccgugcugcccgcccuggccguguucgcccuggcccccgugguguucgccgaggacccccaccugagaaacagacccggcaagggccacaacuacaucgacggcaugacccaggaggacgccaccugcaagcccgugaccuacgccggcgccugcagcagcuucgacgugcugcuggagaagggcaaguucccccuguuccagagcuacgcccaccacagaacccugcuggaggccgugcacgacaccaucaucgccaaggccgacccccccagcugcgaccugcagagcgcccacggcaaccccugcaugaaggagaagcuggugaugaagacccacugccccaacgacuaccagagcgcccacuaccugaacaacgacggcaagauggccagcgugaagugcccccccaaguacgagcugaccgaggacugcaacuucugcagacagaugaccggcgccagccugaagaagggcagcuacccccugcaggaccuguucugccagagcagcgaggacgacggcagcaagcugaagaccaagaugaagggcgugugcgaggugggcgugcaggcccugaagaagugcgacggccagcugagcaccgcccacgagguggugcccuucgccguguucaagaacagccagaagguguaccuggacaagcuggaccugaagaccgaggagaaccugcugcccgacagcuucgugugcuucgagcacaagggccaguacaagggcaccauggacagcggccagaccaagagagagcugaagagcuucgacaucagccagugccccaagaucggcggccacggcagaaagaagagaaccggcgacgccgccuucugcagcgccuacgagugcaccgcccaguacgccaacgccuacugcagcagagccaacggcagcggcaucgugcagauccaggugagcagaguguggaagaagccccugugcgugggcuacgagagagugguggugaagagagagcugagcgccaagcccauccagagaguggagcccugcaccaccugcaucaccaagugcgagccccacggccugguggugagaagcaccggcuucaagaucagcagcgccguggccugcgccagcggcgugugcgugaccggcagccagagccccagcaccgagaucacccugaaguaccccggcaucagccagagcagcggcggcgacaucggcgugcacauggcccacgacgaccagagcgugagcagcaagaucguggcccacugccccccccaggaccccugccuggugcacggcugcaucgugugcgcccacggccugaucaacaaccagagccacagcgcccugagcgccuucguggugaucuucguguucagcagcaccgccaucaucugccuggccgugcuguacagagugcugaagugccugaagaucgcccccagaaaggugcugaacccccugauguggaucaccgccuucaucagauggguguacaagaagaugguggccagaguggccgacaacaucaaccaggugaacagagagaucggcuggauggagggcggccagcuggcccugggcaaccccgcccccauccccagacacgcccccauccccagauacagcaccuaccugaugcugcugcugaucgugagcuacgccagcgcc

SEQ ID NO: 9719 - RNA, 1521 nt, Artificial Sequence
  derived and/or modified CDS sequence (opt4) from RVFV(ZH-548)__DQ380206.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9720 - RNA, 1521 nt, Artificial Sequence
  derived and/or modified CDS sequence (opt4) from RVFV(35/74)__JF784387.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9721 - RNA, 1521 nt, Artificial Sequence
  derived and/or modified CDS sequence (opt4) from RVFV(200803162)__JF311377.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9722 - RNA, 1521 nt, Artificial Sequence
  derived and/or modified CDS sequence (opt4) from RVFV(200803166)__JF311381.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacguggugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9723 - RNA, 1521 nt, Artificial Sequence
  derived and/or modified CDS sequence (opt4) from RVFV(SA-51 (Van Wyck))__DQ380195.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggaggugaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9724 - RNA, 1521 nt, Artificial Sequence
  derived and/or modified CDS sequence (opt4) from RVFV(ZINGA J83 R1)__KU978776.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9725 - RNA, 1521 nt, Artificial Sequence
  derived and/or modified CDS sequence (opt4) from RVFV(Entebbe)__DQ380191.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9726 - RNA, 1521 nt, Artificial Sequence
  derived and/or modified CDS sequence (opt4) from RVFV(Sudan 2V-2007)__JQ820490.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugauggccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9727 - RNA, 1521 nt, Artificial Sequence
  derived and/or modified CDS sequence (opt4) from RVFV(Sudan 86-2010)__JQ820489.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugaucuucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9728 - RNA, 1521 nt, Artificial Sequence
  derived and/or modified CDS sequence (opt4) from RVFV(Kenya 56 (IB8))__DQ380190.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucguggccuucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9729 - RNA, 1521 nt, Artificial Sequence
  derived and/or modified CDS sequence (opt4) from RVFV(ARD-38388)__DQ380187.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucaucggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcauccugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9730 - RNA, 1521 nt, Artificial Sequence
  derived and/or modified CDS sequence (opt4) from RVFV(Sudan 28-2010)__JQ820491.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggugcugagcaucggccuguucuuccugcugaucuaccugggcagaaccggccugagcaagauguggcuggccgccaccaagaaggccagc

SEQ ID NO: 9731 - RNA, 1521 nt, Artificial Sequence
  derived and/or modified CDS sequence (opt4) from RVFV(200803167)__JF311382.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccaugcugcugaucugccuguacguggcccugagcaucggccuguucuuccugcugaucuaccugggcagaaccggccugagcaagauguggcuggccgccaccaagaaggccagc

SEQ ID NO: 9732 - RNA, 1521 nt, Artificial Sequence
  derived and/or modified CDS sequence (opt4) from RVFV(73HB1230)__DQ380221.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaucaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9733 - RNA, 1521 nt, Artificial Sequence
  derived and/or modified CDS sequence (opt4) from RVFV(2250/74)__DQ380209.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccaaggugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9734 - RNA, 1521 nt, Artificial Sequence
  derived and/or modified CDS sequence (opt4) from RVFV(SAUDI 200010901)__KU978778.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9735 - RNA, 1521 nt, Artificial Sequence
  derived and/or modified CDS sequence (opt4) from RVFV(Lunyo)__KU167026.1__Gc
ugcagcgagcugauccaggccagcagcagaaucaccaccugcagcaccgagggcgugaacaccagaugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9736 - RNA, 1521 nt, Artificial Sequence
  derived and/or modified CDS sequence (opt4) from RVFV(25010-24)__KM210509.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9737 - RNA, 1521 nt, Artificial Sequence
  derived and/or modified CDS sequence (opt4) from RVFV(2007000253)__JF326192.1__Gc
ugcagcgagcugauccaggccagcagcagaaucaccaccugcagcaccgagggcgugaacaccaagugcagacugagcggcaccgcccugaucagagccggcagcgccggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9738 - RNA, 1521 nt, Artificial Sequence
  derived and/or modified CDS sequence (opt4) from RVFV(ZC-3349)__DQ380207.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugaaggcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9739 - RNA, 1521 nt, Artificial Sequence
  derived and/or modified CDS sequence (opt4) from RVFV(OS-1)__DQ380186.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugaagguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9740 - RNA, 1521 nt, Artificial Sequence
  derived and/or modified CDS sequence (opt4) from RVFV(KEN/Gar-004/06)__HM586964.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugagauucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9741 - RNA, 1521 nt, Artificial Sequence
  derived and/or modified CDS sequence (opt4) from RVFV(Smithburn)__DQ380193.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuucuuccugaucuaccugggcagaaccggccugagcaagauguggcuggccgccaccaagaaggccagc

SEQ ID NO: 9742 - RNA, 1521 nt, Artificial Sequence
  derived and/or modified CDS sequence (opt4) from RVFV(2008/00101)__HE687306.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccacccugcugaucugccuguacguggcccugagcaucggccuguucuuccugcugaucuaccugggcagaaccggccugagcaagauguggcuggccgccaccaagaaggccagc

SEQ ID NO: 9743 - RNA, 1521 nt, Artificial Sequence
  derived and/or modified CDS sequence (opt4) from RVFV(2007001292)__EU574046.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaaccuguucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9744 - RNA, 1521 nt, Artificial Sequence
  derived and/or modified CDS sequence (opt4) from RVFV(2007002445)__EU574037.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcauccaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9745 - RNA, 1521 nt, Artificial Sequence
  derived and/or modified CDS sequence (opt4) from RVFV(Ken 199800523)__KU978777.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugaacgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggagggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9746 - RNA, 1521 nt, Artificial Sequence
  derived and/or modified CDS sequence (opt4) from RVFV(clone 13)__DQ380213.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggacgaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9747 - RNA, 1521 nt, Artificial Sequence
  derived and/or modified CDS sequence (opt4) from RVFV(2373/74)__DQ380194.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcacccuggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9748 - RNA, 1521 nt, Artificial Sequence
  derived and/or modified CDS sequence (opt4) from RVFV(OS-8)__DQ380185.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugagaaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugagcggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9749 - RNA, 1521 nt, Artificial Sequence
  derived and/or modified CDS sequence (opt4) from RVFV(KEN/Bar-035/07)__HM586969.1__Gc
ugcagcgagcugauccaggccagcagcagaaucaccaccugcagcaccgagggcgugaacaccaagugcagacugagcggcaccgcccugaucagagccagaagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9750 - RNA, 1521 nt, Artificial Sequence
  derived and/or modified CDS sequence (opt4) from RVFV(MgH824)__DQ380210.1__Gc
ugcagcgagcugauccaggccagcagcagaaucaccaccugcagcaccgagggcguggacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuuccccgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9751 - RNA, 1521 nt, Artificial Sequence
  derived and/or modified CDS sequence (opt4) from RVFV(200803169)__JF311384.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaagguggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgaggugagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9752 - RNA, 1521 nt, Artificial Sequence
  derived and/or modified CDS sequence (opt4) from RVFV(2007001811)__EU574040.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaugaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgagaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9753 - RNA, 1521 nt, Artificial Sequence
  derived and/or modified CDS sequence (opt4) from RVFV(Kenya 57 (Rintoul))__DQ380192.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccguggaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagaucagcagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9754 - RNA, 1521 nt, Artificial Sequence
  derived and/or modified CDS sequence (opt4) from RVFV(Beijing-01)__KX611606.1__Gc
ugcagcgagcugauccaggccagcagcagaaucaccaccugcagcaccgagggcgugaacaccaagugcagacugagcggcaccgcccugaucagagccggcagcgugggcgccgaggccugccugauguucgagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9755 - RNA, 1521 nt, Artificial Sequence
  derived and/or modified CDS sequence (opt4) from RVFV(ANK-6087)__DQ380216.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcagcaccaaccugaucgaccccuucgugguguucaagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugagaggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9756 - RNA, 1521 nt, Artificial Sequence
  derived and/or modified CDS sequence (opt4) from RVFV(MP12)__Z30318.1__Gc
ugcagcgagcugauccaggccagcagcagaaucaccaccugcagcaccgagggcgugaacaccaagugcagacugagcggcaccgcccugaucagagccggcagcgugggcgccgaggccugccugaugcugaagggcgugaaggaggaccagaccaaguuccugaagcugaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccugaucagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugauguucgacaacuucgagguggacuucgugggcgccgccgugagcugcgacgccgccuuccugaaccugaccggcugcuacagcugcaacgccggcgccagagugugccugagcaucaccagcaccggcaccggcagccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcggcaccggccugagcaagauguggcuggccgccaccaagaaggccagc

SEQ ID NO: 9757 - RNA, 1521 nt, Artificial Sequence
  derived and/or modified CDS sequence (opt4) from RVFV(KEN/Bar-032/07)__HM586968.1__Gc
ugcagcgagcugauccaggccagcagcagaaucaccaccugcagcaccgagggcgugaacaccaagugcagacugagccacaccgcccugaucagagccggcagcgugggcgccgaggccugccugaugcugaagggcgugaaggaggaccagaccaaguuccugaagaucaagaccgugagcagcgagcugagcugcagagagggccagagcuacuggaccggcagcuucagccccaagugccugagcagcagaagaugccaccuggugggcgagugccacgugaacagaugccugagcuggagagacaacgagaccagcgccgaguucagcuucgugggcgagagcaccaccaugagagagaacaagugcuucgagcagugcggcggcuggggcugcggcugcuucaacgugaaccccagcugccuguucgugcacaccuaccugcagagcgugagaaaggaggcccugagaguguucaacugcaucgacugggugcacaagcugacccuggagaucaccgacuucgacggcagcgugagcaccaucgaccugggcgccagcagcagcagauucaccaacuggggcagcgugagccugagccuggacgccgagggcaucagcggcagcaacagcuucagcuucaucgagagccccggcaagggcuacgccaucguggacgagcccuucagcgagauccccagacagggcuuccugggcgagaucagaugcaacagcgagagcagcgugcugagcgcccacgagagcugccugagagcccccaaccuggugagcuacaagcccaugaucgaccagcuggagugcaccaccaaccugaucgaccccuucgugguguucgagagaggcagccugccccagaccagaaacgacaagaccuucgccgccagcaagggcaacagaggcgugcaggccuucagcaagggcagcgugcaggccgaccugacccugagauucgacaacuucgagguggacuucgugggcgccgccgugagcugcgacgccgccuuccugaaccugaccggcugcuacagcugcaacgccggcgccagagugugccugagcaucaccagcaccggcaccggcacccugagcgcccacaacaaggacggcagccugcacaucgugcugcccagcgagaacggcaccaaggaccagugccagauccugcacuucaccgugcccgagguggaggaggaguucauguacagcugcgacggcgacgagagaccccugcuggugaagggcacccugaucgccaucgaccccuucgacgacagaagagaggccggcggcgagagcaccguggugaaccccaagagcggcagcuggaacuucuucgacugguucagcggccugaugagcugguucggcggcccccugaagaccauccugcugaucugccuguacguggcccugagcaucggccuguucuuccugcugaucuaccugggcagaaccggccugagcaagauguggcuggccgccaccaagaaggccagc

SEQ ID NO: 9758 - RNA, 4020 nt, Artificial Sequence
  derived and/or modified CDS sequence (opt4) from SFNV(Toscana)__NC_006320.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagacugcaagagagacaucaugagcaacuacguggccgaggugcacagcaaccugcacggccugggcgccaugaugcacaacuacggcgacgacaagagaguggaggugcugaacgacgugauccccgacgagcugaaccccggcagacacaacugcagcgaccuggacagaaagcccuucuggaccgaguucaucaacguggccaagcccgccaacaagaucgcccccaucagcgugauccccccccccaucgugaagcccauccccaucgccgagagcaccaucaagaagaccauccccuucgacaagcugcugagcgaggccgagaaggagcugaaccagaccaagaucagacuggagaccgagagaagaagcaacgccgaggaggccgccagagagagagccagaaugagagagaucgaggacaagcugagaaagaacugggagcuggagagagagagaaaggacgccguggccgacgaccuggccaaggagaucgccagaagaagagagaucgagagaaaggcccacgagcuggacaagaugcugaagaagaaggagagagaggaccagguggccaucgagagagugagcgaggacaugagaaaccacgugagaagacccaacaccaccaucgcccccgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcaagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcaacaacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagagaggcuggaccgagagcauccccagcaccagauacagcaaggaccugugcagcaucggccugcacaccgugaaggagugcaagaccggcaccaccaacuucgagagagugggcuucaucguggugaagagcagaaagauguacaucgagcagaugaagaugagaagcagacaggaguucagcgaggaccaguuccugugcuacaagagcgagagcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagauggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagaagcuguucuacuggcugaucaccccccugugcuggcugagcguguucugcggcuggaugaucaagagcuggaagaagaaggugggcagcgccaucagcagaaccaacgacaccaucggcuggagagacaacagaagauacggcagagacguggagagagcccaguacaccggcggcgcccccggcgccaaguacagcuucuacggcgugaugauccugggccugcugggcaacgugcacagcugcagcgagagcgugaucgccgacagcaaggugaugcagugcaccaccagcggcagcagcacccugugcaaggccagcggcaccgugaucaugaagcugggccccaucggcagcgagagcugccugauccugaagggccugaaggacaacgagaagcaguucaucagcaucaagaccaucagcagcgagcugaccugcagagagggcgagagcuucuggaccacccuguacacccccgugugccugagcagcagaagaugccaccugaugggcgagugcugcagcgacagaugccugaaguggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcauccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacgccuacagcuucaugaagcacggcagcggcagccuggccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccacaacagccagagcgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagccccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaccaucgccagaaccggcguggagcaggcccugaagaagaagaacaaguga

SEQ ID NO: 9759 - RNA, 3972 nt, Artificial Sequence
  derived and/or modified CDS sequence (opt4) from SFNV__HM566171.1__GP
augcugaacaccaagagcaucauccugaucaccugccuggugcagcaggugcaccugaaguacaccaucaucagcgaggugaccaagggcgccagagaggugagcugcuacagcagcaccaccagacuggaccagcugcuggaggccugggagaacaagagcgcccugaugggccugagaaagggcaacugcaagcugggcgccauggagcagguggacugcaaccuggaccugaugagcaacuacgugagcaacguguacgacaacccccacggccugggcgccaugauguacaacgacaagagaaucgaggugcugaacgaccagauccccgacagcaugauccccggcggccacaacugcagccugcuggagagaaagcccuucugggccgaccugauccccagcaagaaggagaaccccagacccagccugaucagccuggugcccacccccagaagcgacuucaagagaaaguucgaggaggccgaggaggagaugaagaagaucagaaaggagcugcaggacgagagacaggcccagcugagcgugaucgaggagggcagaaagagaaugagagaccuggaggacaagcugaugagacaguggaacgaggagaagcagaagaagggccugcuggaggagacccuggagaagaagagacagcugaagaacaaggcccugcuggacgcccacaaccuggacaagcagcugaaggagaaggacagagaguucaagaccgccauggaggagcaccagaacgagagacacagaaucaacagcaacaugaucagaccccccaucaccacccccgccgccgugauccugaccagccugcugagcgccagcguggugcugggcuucgagcuggagaacagaaacaccaaccacgcccugaacagacccggcaacggcggcuacagcaucagcgacaacaaccugaucgaggccaagugcaugaucaccuacggcaacaagugccccagcugggagaugcagcuggaccccgugagcuaccccuucuucagcagcaacuucgagaaguacagccugcuggagagcaucagcgagaccagccccaucaucggcaaguucagcgaggugugcgugcugagcaaccugcccggcgcccagaagaccugcgccaaggaggccagccugaucaagaagcagugcagcgacgacaugagagccuacuucuacaucaacagccugggcaagcuggccaucgugaccugccccgagaacaacgugcugagccaggacugcaacuucugccugagaaaggccaagggcgagcaguacguguacaagcccauccaggacggcuucugccagaacggcggcgugagcagcgugcccagcaucagauacagcaaggacaucugcagcaucggccccaccaaggugaagaacugccacaagggcaccagcagauacgagagaaccgccuucaucagcaccggcgacaagaagguguaccuggaggagaucaagaucagaagcagacaggaguacgagcccgaccaguuccugugcuacaaggugaaggacagcagcagcagcccccuggccuacgagaaggugcaggugagcaagugcaagggcaucgagaccaacagccccaagaagugcaccggcgacgaguacuucugcagcaaguaccccugcgagagcaccagccccgaggccaacugcuuccugagaaagcacagcgccauccuggaggugaacaucggcggcauguggaucaagcccaagugcaucggcuacgagauggcccuggugaagagagugggccugagaagcgaggacgugagcagcaaggagugcgccaccugccugugggagugcagcagcggcuacaucagcaucaccacccacggccccaagaucagcuacgccaccgccugcagccacggcagcugcaagagcaucgugcagaaccccagcaccagcaucagaaucagcuaccccggcaacagcgagaucgugggcggcgacaucggcauccaccugaccgaggacagcagccccaucaaccugcaccugaagauccacugcagccccaaggacagcugcgaggugagcgacugcaucuucugcgugcacggccugcugaacuaccagugccacagcguggccagcgcccugcugcugagcaccaucaccgccagccugaucgugcugaugaucuacaugcugagcaagaccaaguucgugaugaagaagcugauccccaucaugcugaccccccugugcuggugcuucgugcugcuggccuggcugaccaagagcuggaagggcaagaugagaaacgccauccagagcgccaacagcaccaucggcuggaccgagagagaggagagaaucguggccgagagacccagaagcagaaacaccgugagauacagcuucuacggcguggugauccuggccaugcuggagagcgccuucggcugcagcgagagccugaucgccgagagcaaggugaugcagugcaacaucgccaacggcaagaccagcugcagagccagcggcaccaucaucaugaagcugggccccaucggcagcgaggccugccugauccugaagggccugagagacagcgacaagcaguacaucagcgugaagaccgagagcagcgagcugaucugcagagagggcgagagcuucuggaccagccuguacacccccgugugccugagcagcagaagaugccaccugaugggcgagugcaccggcgaccugugccugaaguggaagagcaacaagaccagccuggaguucgccggcaagaccagaagcgacgugaucaacgagaacaagugcuucgagcagagcggcggccugggcuacggcugcuucaacgugaaccccagcugccuguacacccacgccuaccugaagagcguguacagaaacggcuucagaguguucaagugcgccagcuggacccacagagugaagcugaccaucaccacccacagcagaaccuuccccaugacccuggccgccaugagcacccagcccaccgacuggggcagcaucggccugauccuggacagcgagggcaucagcggcaccaacagcuucagcuucaugaagcacggccugggcagcuucgccaucaucgacgagcccuacagcauggagcccagaaagggcuucaucggcgaggugagaugccccaccgaggaggccgccaucaaggccagcacccugugcaagaccgccccccagcugaucgaguaccagcccgagauggacagcgccgagugcaccaccaacaugaucgaccccaugagcguguucaacagaggcagccugccccaggugagagagggcaugaccuucacccagagcauggagaagaacaccgugcaggccaugaccaccggcgaggugcacgccagcaucagaaucgugcuggacgacuacgagguggaguaccugagcagccagguggacugcgacgccaccuucaagaaccugaccggcugcuacagcugcgacgagggcgccagagugugcaugcagaucaucgcccacggcgacaccaucuuccacuucagaaaccccgacgugagcaucaacauccugcagaaggugaacaccaacacccugaucuacugcagcguggugcacuucagcaagcccgugaucaaggaggagggcaccuacgacugcggcgccggcgagaagcccaugauccugaagggcacccugguggccgugagcccccacaacgacagacuggagcagggcggcagcagcaucgugaucaaccccaagggcggcggcguggacuuccugggcuggcugagcggcuucagcagcugguucggcggcccccugaaggccauccugauggugaucggcuuccugcugcugggccugauccuguucgugaccaucgccaucggccugaaguucgcccugagacagaugaucgugaagagaaugaaguga

SEQ ID NO: 9760 - RNA, 3873 nt, Artificial Sequence; identical to SEQ ID NO: 9443
  derived and/or modified CDS sequence (opt4) from SFNV(Namru)__HM566169.1__GP

SEQ ID NO: 9761 - RNA, 3990 nt, Artificial Sequence
  derived and/or modified CDS sequence (opt4) from SFNV/SFNV-like(Poona)__HM566177.1__GP
augcugaacgugaagagcgugauccugaucaccugccuggugcagcaggcccaccugaaguacaccaucaucagcgagguggccaagggcgccagagaggugagcugcuacagcagcaccaccagacuggaccagcugcuggaggccugggagaacaagagcgcccugaucggccugaagagaggcaacugcaagcugggcgccauggagcagaucaacugcaaccuggaccugaugagcaacuacgugagcaacguguacgacaacccccacggccugggcgccaugauguacaacaccgacagcgacaagagaaucgaggugcugaacgaccagauccccgacagcaugauccccggcggccacaacugcagccugcuggagagaaagcccuucugggccgaccugaucccccccaagaaggagaaggagcuggaccccaagcccagccugaucagccuggugcccacccccagagacgacuucaagaagaaguucgaggaggccgaggaggagaugaagaagaucagaaaggagcugcagaacgagagacaggcccagcugagcgugauggaggacagcagaaagaagaugagagaccuggaggacagacugaugagacagugggaggaggagaagcagaagaagggccugcuggaggagacccuggagaaggagagacagcugaagaacaaggcccugcuggacgcccacgaccuggacaagcagcugaaggagagagacagagaguucaagaccgccauggaggagcaccagaacgagagaagaagaaucaacagcaacaugaucagacccuacgugaccacccccgccgccaucauccugaccagccugcugagcgccagcgugguggugggcuucgagcuggagaacagaaacaccaaccacgugcugaacagacccggcaacggcggcuacagcaucagcgacaacaaccugaucgaggccaagugcaugaucaccuacggcaccaagugccugagcugggagaugcagcugaaccccgugagcuaccccuucuucagcagcaacuucgagaaguacagccugcuggagagcgugagcgagaccacccccaucaucggcaaguucagcgaggugugcgugcugagcaaccugagcggcgcccagaagaccugcgccaaggaggccagccugaucaagaagcagugccccgacgacaucagagccuacuucuacaucaacagccugggcaagcuggccaucgugaccugccccgagaacaacgugcugagccaggacugcaacuucugcgugcccaaggccaagggcgagagauacaucuacaagcccauccaggacggcuucugccagaacggcggcgugagcaccgugcccagcgugagauacagcaaggacaucugcagcaucggcccccugaaggugaagaacugccacaagggcaccagcagauacgagagaaccgccuucaucagcaccggcgacaagaagguguaccuggaggaggugaagaucagaagcagacaggaguacgagcccgaccaguuccugugcuacaaggugaaggacggcagcagcagcccccugguguacgagaaggugcaggugagcaagugcaagggcaucgagaccaacagccccaagaagugcaccggcgacgaguacuucugcagcaaguaccccugcgagagcaccagccccgaggccaacugcuaccugagaaagcacagcgccaucaucgaggugaacaucggcggcaugugggugaagcccaagugcgugggcuacgagauggcccuggugaagagagugggccugagaagcgaggacgugagccugaaggagugcgccaccugccugugggagugcagcagcagcuacaucagcaucaccacccacggccccaagaucagcuacgccaccgccugcagccacggcagcugcaagagcguggugcagagccccagcaccagcaucaagaucagcuaccccggcaacagcgagaucgugggcggcgacaucggcauccaccugaccgaggacagcagccccgugaaccugcaccugaagauccacugcccccccaaggacagcugcgaggugagcgacugcauccugugcgugcacggccugcugaacuaccagugccacagcguggccagcgcccugcugcugagcaccaucaucgccagccugaucgcccuggugguguacaugcugagcaagaccagauucgugaugagaaagaucgugcccaucauguucauccccuucugcuggugcuucgugcugcuggccuggcugaccagaagcuggaagggcaaggugagaaacgccauccagagcgccaacaacaccaucggcuggaccgagagagaggagagagugaucgccgagagacccggcggcagaaacaccaucagauacagcuucuacggcguggugauccuggccauccuggagagcgccuucggcugcagcgagagccugaucgccgagagcaagaucaugcagugcaacaucgccaacggcaagaccagcugcagagccagcggcaccaucaucaugaagcugggccccaucggcagcgaggccugccugauccugaagggccugagagacagcgacaagcaguacaucagcgugaagaccgagagcagcgagcugaucugcagagagggcgagagcuucuggaccagccuguacacccccgugugccugagcagcagaagaugccaccugaugggcgagugcaccggcgaccugugccugaaguggaagagcaacaagaccagccuggaguucgccggcaagacccacagcgaggugaugaacgagaacagaugcuucgagcagagcggcggccugggcuacggcugcuucaacaucaaccccagcugccuguacacccacgccuaccugaagagcguguacagaaacggcuucagaguguucaagugcgccagcuggacccacagagugagacugaccaucaccacccacagcagaaccuuccccaugacccuggccgccaugagcacccagcccaccgacuggggcagcaucggccugauccuggacagcgagggcaucagcggcaccaacagcuucagcuucaugaagcacggccugggcagcuucgccaucaucgacgagcccuacagcauggagcccagaaagggcuucaucggcgaggugagaugccccaccgaggaggccgccaucaaggccagcacccugugcaagaccgccccccagcugaucgaguaccagcccgagauggacagcguggagugcaccaccaacaugaucgaccccaugagcaucuucaacagaggcagccugccccaggugagagagggcaugaccuucacccagagcauggagaagaacaccgugcaggccaugaccaccggcgaggugcacgccagcaucagacuggugcuggacgacuacgagguggaguaccugagcaaccagguggacugcgacgccaccuucaagaaccugaccggcugcuacagcugcgacgagggcgccagagugugcaugcagaucaaggcccacggcgacaccaucuuccacuucaagaacagcgacaugagcaugaacauccugcagaaggugagcaccaacacccugaucuacugcagcguggugcacuucagcaagcccgugaucaaggaggagggcguguacgacugcggcgccggcgagaagcccaugauccugaagggcacccugguggccgugagcccccacaacgacagacuggagcagggcggcagcagcaucgugaucaaccccaagggcagcggcguggacuuccugggcuggcugagcggcuucagcagcugguucggcggcccccugaaggccauccugaccgugaucggcuuccugcugcugggcuuccugcuguucaugcuggugaccaucggccugagauacgcccugagccagguggugaccaagaagaugaaguga

SEQ ID NO: 9762 - RNA, 4002 nt, Artificial Sequence
  derived and/or modified CDS sequence (opt4) from Arrabida virus(PoSFPhlebV/126/2008)__KP863800.1__GP
auguucuacgccaaguucauccugcugcugugcuucgugcagggcgcccugcugaaguacaccaucaucagcaaggugggcagcagcaccuacaagagagugugccugagccacaccaccgaccuggacacccugcuggacaugaccagcagagagaugagcaacaucaagcugaccggcggcagcugcagccugggcgaccugaccaagcccgacugcagccccgacuucuucagcaacuacguggccaacauccagagcagcaacaccaagaucaccggcaaguuccaggacaucaucggcgagagagagauggaggugaccaacgacguggugcccgacagcuucggccccggcccccacgacugcgugagcuucgacaagaagcccuucuggagcgaccugcugcccaccagcgugagcaaggaggagcccaagcccaucaucagcacccugagcgugcugcccgccgccccccccaucaaggacuucagccacaaggugguggaggccgaggagauggugaaggagaucgagggcgagcugaugaaggagaaggagagaaacagcgccaaggaggaggaggccagacagagaaugagagagcuggaggacgaccugagaaagcagugggccgccgagagaauggccaagcagaacaugagcagcgugcuggagagagagagacaggagaagcagagccuggagagaagaaugcacgagguggacaagaagcugagagccagcgaggacagagcccagaaguaccaggagagagccgagcaggccgagaagagccacagcaagcugcugagcagaagcggcgccgccaccaccauggccaccgugguguucaccagccugcuggccagcggccuggccguggugaccgagcuggagaagagagacaccaaccaccugcugaacagacccggcaacggcguguacauggccaacgccgacagccugauccagaccgagugcacccugaacuacggccagagaugccuggccugggagcugcagaucacccccgugagauaccccuucuucaccagcaacguggacaaguacagccugcuggagagcaucaccgagacccccagcauccuggagaagaacaacgagagcugccagcuggccaccaccagcggcagccugaagaccugcgccaaggaggccagcaccaucaagaagcacugcaccgacgacgugagagccuucuucuucaucaacagcgugggcaagcugaccaucgugagaugcgccgacaaccacauccugagcgaggacugcaacuucugcaucagcaaggccagaaacagcaaccagaacauguucaugcccgugcaggacgccuucugccagagacagggcagcgacaccgcccccgccaucagauacagcaaggacaucugcagcaucggcgccaucaagaucaagcagugccacaaggccaccagcaaguucgagagaaugggcuucaucagcgugggccagaagaagcuguacaucgaggagcugaagcugagauacagacaggaguacgaccccgaccaguucaugugcuacaagaucaagagcagcagcccccugaaguacgagaaggugagcagcaagaagugcaaggagguggacaccggcggcaaccagaagugcagcggcgacgagcacuucugcaacagauaccccugcgacaccgccaaccccgaggcccacugccugaccagaaagcacagcgccaucgccgaggugaacaucggcggcguguggaucagacccaagugcgugggcuacgagauggugcuggugaagagaagcggccugaagagcgaggaccugagcaucagagacugccccagcugccugugggagugcaagaagagcagaaucaccaucaagacccacggccccaagaucgugagcgccaccgccugcagccacggcagcugcaagagcgugaugcagaagcccagcaccuucguggagauccccuaccccggcaacagcgagaucaucggcggcgacaucggcgugcacaugaccgagagaggcagccccagcaacauccacgugagaacccacugcccccccagagacagcugcgacgugagcgacugcauguucugcgugcacggcauccugaacuaccagugccacacccuggccagcgcccugaccaucgccaccaucgugagcgccgugcugguggugguguacuuccugcuggccagaagcaagagagccgugaaguucaucaccagccugcugaucgugcccuucaaguggcugacccugcugagcaucuggguggugaagaacuggaagagaaagaugagcaagcuggccagagccaccaacaacgccaucggcugggaccaggacguggagagaggcagacccagagccgccgccggccaccagaaccagguggccagauacaccuucuacggcgccaccauccugagccugaugaccagcggccugugcugcaccgagagcgugaucgccgagagcaacaucaugcagugcaccaccagcgacagcaccaccaccugcaaggccagcggcaccaucauccugagacugggccccaucggcagcgagagcugccugauccugaagggccugagagacagcgagaagcaguucaucagcaucagaaccgugagcagcgagcugaccugcagagagggcgacagcuucuggaccagccuguacacccccaucugccugagcagcagaagaugccaccugaugggcgagugcaccggcgacaacugccugaaguggcaggacaacaagaccagcagcgaguucaccggcagaacccacagcgaggugcugcacgagaacaagugcuucgagcagagcggcggcaucggcuacggcugcuucaacgugaaccccagcugccugauggugcacagcuaccugaagcccaucuacaagaacgccuucaagguguucagaugcguggccuggaaccacagagugaagcuggccaucaccacccacaagaagagcuucgacgugacccugauggccaugagcacccagcccaccgacuggggcagcaucggccugauccuggacagcgagggcaucaccggcaccaacagcuacagcuucaugaaguacggcgugggcagcuucgccaucaucgacgagcccuucagcaucgagcccagaaagggcuuccugggcgaggugagaugccccaccgaggagaccgccgugaaggccagccccagcugcaaggccgccccccagaucaucgaguaccaccccgagauggacaccguggagugcaucaccaacaugauggaccccauggccaucuucaacagaggcagccugccccaggugagagacggcgugaccuucgcccagagcaucgagaagaacagcgugcaggcccugaccaccggcgagaucaaggccagcgugagacuggugcuggacgacuacgagguggaguacaaggugagcgagaacgacugcgacagcaccuucaucaacaucaccggcugcuacagcugcgacgagggcgccagacugugcgugagaaucagaacccugggcgacagcaucuaccacuucaccgacagcgaggacaugaugaacgugauguucaaggugaacagcagcgugaccgaguacugcaccgugcugcacuucagcaagcccguggugaacuucgagggcaaguacgacugcggcaagagcagaaagcccaugaucaucaagggcacccugaucgccauggccccccacgacgacagagugcacagcggcggcagcagcaucguggugaaccccaagagcaagggcguggacuuccugggcuggcugagcggccugagcagcuggcugggcggcccccugaagaccgugcugaccgugcugggcuuccugauccugggccugguguucgugaucguggugaucuuccuggugagagugggcaucagacaggcccugcugaagaagaugaaguga

SEQ ID NO: 9763 - RNA, 4005 nt, Artificial Sequence
  derived and/or modified CDS sequence (opt4) from Massilia virus(127)__KT906100.1__GP
auguucuacgccaaguucgugaucagccugugccuggagcccggcuucagccugaaguacaccaucaucagcaagagcggcagcggcaccaucagacagaucugccugagccacagcaccgacaucgacaaggugcuggagcugagcagcggcgagaugaacaccaucggcauccugggcggccugugcaccuucggcgagcugaagagagaggacugcagccccgacguguucagcaacuacguggccaacauguacggcaccgcccaccccagcagcugcaaguucguggacaucaccggcgacagaagcaucgaggugcugaacgacgccgugcccgacagcuucacccccggcgcccacaacugcagcagcuucgagaagaagcccuucuggaccgaccugauccccgccaagaacagcagcggcgccauccccagcguggugagcgugcugcccagcguggccgagcacgacuucaaccugaaggugaaggaggccaacgacaagcuggaggugauccagagagagcuggccgccgagaaggccagaagcggcagacuggaggacgaggccagagccaagaugaaggcccuggaggacgagcugagaaacggcuggcuggccgagagagaggccaaggagcuggccaagagcgcccuggagaaggagagaaucaacaagcuggagguggagagaaagcugcacgaccugggcaagaagcugagacagagcgaggacgacguggagaagaugagagugcaccacaagaagggcagaaaggagagcgacgaggagaugaagaucgccagaaccaccgcccccagcgugagcaccacccuggccaccgugguguucaccagccugcuggccaccggccuggccgccaucgagcccaucgaggacagaaacgugaaccacauccugaacagacccggcagcggcguguacauggccagccccacccugacccagaacgagugcagccuggacuacggcaaggagugcaaggccugggagcugcaggugagcccccugcacuaccccuucuucaccagcaacguggacaaguacaccuuccuggagagcaucacccugcugccccccauccugcugaucaacaacgaguucugcgagcugaccaccagcagcggcccccugaagcagugccagaaggagagcagccugaucaagaagugcugcaccgaggacgccagagccuacuucuucaucgaccuggagggcaagcugagcaucgugcacugcagcaacaaccaggugcugagcgaggacugcaacuucugcgugaccaagagcggcggcgugagccacaagaucuucaugcccauccaggacgccuucugccagaagggcggcagcgagagcauccccguggugagauacagcaaggacaucugcagcaucggccugagcaaggugaagagcugccacaagagcaccagcagauacgagagaaugggcuucaucguggccggcaagaagaagcuguacaucgaggaccugaagaugagauacagacaggaguacgacgaggaccaguucuucugcuacaaggugaacaagaccagcccccuggaguacggcaaggagagccccagcaagugcaagggcgugggcagcaacgagcagaagugcaacggcgacgaguacuucugcaacagauaccccugcgagaccaacagccccgaggcccacugcagccugagaagacacgccgccgugguggagguguacgugggcggcgccuggaucaagcccaagugcgugggcuacgagaaggugcuggugaagagaggcggccugaagaccgaggaccugagcgugagagagugcaccagcugccugugggagugcgagaagaacaagaucgugaucaagacccacggccccaagaucgugagcgccaccgccugcggcggcagaagcuggaagagcgugaugcagaagcccagcaccuuccuggaccugcccuaccccggcaacagcgagaucaucggcggcgacagaggcaaccaccugagcgagagaggcagccccuacaacauccacagcaccauccacagcccccccgaggacagcagagacgccagcgacugcaucuacugcagacacggccugcugaacuaccagagccacagcguggagagcgccauccugcugagcaccgugguggccaccauccuggcccugaccggcguggugcugagcagaagcaagagcgccgugagauuccuggccagcgccguggccgugcccuucagaugggugagccugcugguggugugggugaugaagaaguggaaggccagaguggccaccgccaucagagccaccaacaacgccaucggcugggacaacggccuggagcaggccagaguggagaacgccgccagaagacagcagaccgccggcagauggagaagccuggacgccagcaccauccugagcgugcugagcaccggccugugcugcaccgagagccugaucgccgagagcagcaucaugcagugcaccaccggcgagggcagcaccaccugcaaggccaccggcaccguggugcugaagcugggccccaucggcagcgagagcugccugauccugaagggccugagagacaacgagagacaguucaucagcaucaagaccaucagcagcgagcugaccugcagagagggcgagagcuucuggaccccccuguacacccccgugugccugagcagcagaagaugccaccugaugggcgagugcaccggcgacaugugccugaaguggaagagcaacaagaccagcagcgaguucaccggcaagacccacagcgaggugauccacgagaacaagugcuucgagcagagcggcggcaucggcuacaugugcuucaacgugaaccccagcugccugauggugcacagcuaccugaagcccaucuacaagaacgccuucaagguguucagaugcaucgccuggaaccacagagugagacugggcaucaccacccacaagagaaaguucgaggugacccugauggccaugagcacccagcaggccgacuggggcagcaucggccugauccuggacagcgagggcaucagcggcaccaacagcuacagcuucaugaagcacggccugggcagcuacgccaucaucgacgagcccuacagcguggagcccagaaagggcuaccugggcgaggugagaugccccaccgaggagaccgccaucaaggccagccccagcugcaagguggcccccggccugguggaguaccagcccgagauggacacccuggagugcaccaccaacaugauggaccccauggccaucuucaacagaggcagccugccccaggugagaggcggcuggaccuucagccagagcaucgagaagaacagcagacaggcccugaacaccggcgccaucaacgccagcgugagacacgugcuggacgaguacgaguucgacuacaaggugaagaccaacgacugcgacagcaccuucgugaacaucaccggcugcuacagcugcgacgagggcgccagacugugcgugaaggugagaaccagcagcgaggccaucuaccacuucaccgacagcggcuacaacaucaacgugcuguucaagguggagagcggcgugcacgaccacugcaccauccugcacuucagcaagcccgugaucagcaucgagggcaaguacgacugcggcaagaacaagaagcccaugcugaucaagggcacccugaucgccauggccccccacgacgacagaguggugagcggcggcagcagcaccguggugaaccccaagggccagggcguggacuuccugggcuggcugagcagacugagcagcugguucggcggcggcccccugaagaccuuccugauggugaccggcuuccugaugaccggcgugaucggcggcaucgugaccaucauccugaucagaaucgugcugcagcaggcccuggccaagaaggugaaguga

SEQ ID NO: 9764 - RNA, 4005 nt, Artificial Sequence
  derived and/or modified CDS sequence (opt4) from Massilia virus(130)__KT906101.1__GP
auguucuacgccaaguucgugaucagccugugccuggagcccggcuucagccugaaguacaccaucaucagcaagagcggcagcggcaccaucagacagaucugccugagccacagcaccgacaucgacaaggugcuggagcugagcagaggcgagauggacaccaucagcauccugggcggccugugcaccuucggcgagcugaagagagaggacugcagccccgacguguucagcaacuacguggccaacauguacggcaccacccaccccagcagcugcaaguucguggacaucaucggcgacagaagcaucgaggugcugaacgacgccgugcccgacagcuucacccccggcgcccacaacugcagcagcuucgagaagaagcccuucuggaccgaccugauccccgccaagaacagcagcggcgccauccccagcguggugagcgugcugcccagcguggccgagcacgacuucaaccugaaggugaaggaggccaacgagaagcuggaggugauccagagagagcuggccgccgagaaggccagaagcggcagacuggaggacgaggccagagccaagaugaaggcccuggaggacgagcugagaaacggcuggcuggccgagagagaggccaaggagcuggccaagagcgcccuggagaaggagagaaucaacaagcuggagguggagagaaagcugcacgaccugggcaagaagcugagacagagcgaggacgacguggagaagaugagagugcaccacaagaagagaagaaaggagagcgacgaggagaugaagaucgccaagaccaccgcccccagcgugagcaccacccuggccaccgugguguucaccagccugcuggccaccggccuggccgccaucgagcccaucgaggacagaaacgugaaccacauccugaacagacccggcagcggcguguacauggccagccccacccugacccagaacgagugcagccuggacuacggcaaggagugcaaggccugggagcugcaggugagcccccugcacuaccccuucuucaccagcaacguggacaaguacagcauccuggagagcaucacccagagcagccccauccugcugaagaacaacaacagcugcgagcugaccaccagccccggcacccagaagcagugccagaaggagagcagcaccaucaagaaguacugcaccgacgacgccagagccuacuucuucaucgaccuggagggcaagcugagcaucgugcacugcaccaacaacuacauccugagcgaggacugcaacuucugcgugagcaagcugggcgaggugggccacaagaucuucaugcccauccaggacgccuucugccagaagggcggcagcgagagcauccccaucgugagauacagcaaggacaucugcagcaucggccuguucaagaucaagaacugccacaagagcaccagcagauacgagagaaugggcuucaucguggccggcaagaagaagcuguacaucgaggagcugaagaugagauacagacaggaguacgacgaggaccaguucuucugcuacaaggugaagaagaccagcccccuggaguacgccaaggugagccccagcaagugcaagggcgugggcagcaacgagcagaagugcaacggcgacgaguacuucugcaacagauaccccugcgagaccaacagccccgaggcccacugcagccugagaagacacgccgccgugguggagguguacgugggcggcgccuggaucaagcccaagugcgugggcuacgagaaggugcuggugaagagaggcggccugaagaccgaggaccugagcgugagagagugcaccagcugccugugggagugcgagaagaacaagaucgugaucaagacccacggccccaagaucgugagcgccaccgccugcggccacggcagcugcaagagcgugaugcagaagcccagcaccuuccuggaccugcccuaccccggcaacagcgagaucaucggcggcgacagaggcaaccaccugagcgagagaggcagccccuacaacauccacagcaccauccacugcccccccgaggacagcagagacgccagcgacugcaucuacugcagacacggccugcugaacuaccagagccacagcguggccagcgccauccugcugagcaccgugguggccaccauccuggcccugaccggcguggugcugagcagaagcaagagcgccgugagauuccuggccagcgccguggccgugcccuucagaugggugagccugcugguggugugggugaugaagaaguggaaggccagagugaccaccgccaucagagccaccaacaacgccaucggcugggacaacggccuggagcaggugagaguggagaacgccgccagaagacagcagcccgccgugagauggagaagccuggacgccagcaccauccugagcauccugggcaccggccugugcugcaccgagagccugaucgccgagagcagcaucaugcagugcaccaccgaggagggcagcaccaccugcaaggccaccggcaccguggugcugaagcugggccccaucggcagcgagagcugccugauccugaagggccugagagacaacgagaagcaguucaucagcaucaagaccaucagcagcgagcugaccugcagagagggcgagagcuucuggaccagccuguacacccccgugugccugagcagcagaagaugccaccugaugggcgagugcaccggcgacaucugccugaaguggaagagcaacaagaccagcagcgaguucaccggcaagacccacagcgaggugauccacgagaacaagugcuucgagcagagcggcggcaucggcuacaugugcuucaacgugaaccccagcugccugauggugcacagcuaccugaagcccaucuacaagaacgccuucaagguguucagaugcaucgccuggaaccacagagugagacugggcaucaccacccacaagagaaaguucgagaucacccugauggccaugagcacccagcagaccgacuggggcagcaucggccugauccuggacagcgagggcguggccggcaccaacgccuacagcuucaugaagcacggccugggcagcuucgccaucaucgacgagcccuacagcguggagcccagaaagggcuaccugggcgaggugaagggccccagagaggagaccgccaucaaggccagccccagcugccagguggcccccggccugguggaguaccagcccgugauggacaccguggagugcaccaccaacaugauggacccccuggccaucuucaacagaggcagccugccccaggugagaggcggcuggaccuucagccagagcaucgagaagaacagccugcaggcccugaacaccggcgccauccacgccagcgugagacacgugcuggacgaguacgaguucgaguacaaggugaagagcaacgacugcgacagcaccuucgugaacaucaccggcugcuacagcugcgacgagggcgccagacugugcgugaaggugagaaccagcagcgaggccaucuaccacuucaccgacagcggcuacaacaucaacgugcuguucaagguggacagcggcgugcacgaccacugcaccauccugcacuucagcaagcccgugaucagcaucgagggcaaguacgacugcggcaagaacaagaagcccaugcugaucaagggcacccugaucgccauggccccccacgacgacagaguggugagcggcggcagcagcaccguggugaaccccaagggccagggcguggacuuccugggcuggcugagcggccugagcagcugguucggcggcggcccccugaagaccuuccugauggugaccggcuuccugaugaccggcgugaucagcggcaucgugaccaucauccugaucagaaucgugcugcagcaggcccuggccaagaaggugaaguga

SEQ ID NO: 9765 - RNA, 3999 nt, Artificial Sequence
  derived and/or modified CDS sequence (opt4) from Massilia virus(W)__EU725772.1__GP
auguucuacgccaaguucgugaucauccugugccuggugcagggcuucagccugaaguacaccaucaucagcaagagcggcagcggcaccaucagacagaucugccugagccacagcaccgacaucgacaaggugcuggagcugagcagcggcgagauggacaccaucaacauccagggcggccugugcaccuucggcgagcugaagagagaggacugcagccccgacguguucagcaacuacaucgccaacauguacggcaccacccaccccagcagcugcagauuccuggacaucaucggcgacagaagcaucgaggugaugaacgacgccagccccgacagcuucacccccggcgcccacaacugcagcagcuucgagaaggcccccuucuggagcgaccugauccccgccaagaacggcagcggccccagccccagcguggugagcgugcugcccagcgccaccgagagcgacuucagccugaaggugaagaaggccaacgagagacuggaggugauccagagagagcuggccgccgagaaggccagaagcggcagacuggaggacgaggccagaaccaagaugagagcccuggaggacgagcugagaaacggcuggcuggccgagagagaggccaaggagcuggccaagagcgaccuggagaaggagagagugaacaagcuggagguggagagaaagcugcacgaccugaacaagaagcugagacagagcgaggacgaggccgagagacugagagaguaccacaacaagagaagaaaggagagcgacgagaagaugaagaugaccaagaccguggcccccaacgugagcaccacccuggccaccguggugcugaccagccugcuggccaccggccuggccgccaucgagcccaucgaggacagaaacaccaaccacauccugaacagacccggcaccggcguguacauggccagccccacccugaccgagaacgacugcagccuggacuacggcaaggagugcaaggccugggagcugcaggugagcccccugcacuaccccuucuucaccagcaacguggacaaguacagccugcuggagagcaucacccaggccagccccauccugaucaagaacaacaacagcugcgagcugaccaccagccccggcagccagaagcagugccagaaggagagcagcaccaucaagaaguacugcaccgacgacgccagagccuacuucuucguggaccuggagggcaaccugagcaucgugcacugcagcaacaacaacauccugagcgaggacugcaacuucugcaucagcaagagcggcgugaccggccagaagaucuucaugcccauccaggacgccuucugccagagaggcggcagcgagagccugcccgugaucagauacagcaaggacaucugcagcaucggccuguucaagaucaagagcugccacaagagcaccagcagauacgagagaaugggcuucaucguggugggcagaaagaagcuguaccuggaggagcugaagaugagauacagacaggaguacgacgaggaccaguucuacugcuacaaggccaagaccaccagccagcugcaguaccagaaggugagccccagcaagugcaagggcgugggcagcaaggaccagaagugcaacggcgacgaguacuucugcaacagauuccccugcgagaccaacaaccccgacgcccacugcagccugagaagacacgccgccgugguggaggugaacgugggcggcgccugggugaagcccaagugcgugggcuacgagaaggugcuggugaagagaggcggccugaagaccgaggaccugagcgugagagagugcaccagcugccugugggagugcgagaagaacaagaucgugaucaagacccacggccccaagaucgugagcgccaccgccugcagccacggcagcugcaagagcgugaugcagaagcccagcaccuuccuggaccugcccuaccccggcaacagcgagaucaucggcggcgacaucggcauccacaugagcgagagaggcagccccagcaacauccacaucaccauccacugcccccccaaggacagcugcgacgugagcgacugcaucuucugcagacacggcauccugaacuaccagugccacagcguggccagcgccauccugcugagcaccgugguggccaccauccuggcccugaccggcgugaucaucagcagaagcaaguucgccgugagauuccuggccagcgccguggccauccccuucagaugggugagccugcugguggugugggugaugaagaaguggaagagcagaaucgccaccgccaucagagccaccaacaacgccaucggcugggacaacggccuggagcaggugagaguggagaacgccgccagaagaccccagcccgccgugagauacgccuucuacgccaccaccauccugagcauccugggcagcggccugugcugcaccgagagccugaucgccgagagcagcaucaugcagugcaccaccgaggacagcagcaccaccugcaaggccaccggcaccguggugcugaagcugggccccaucggcagcgagagcugccugauccugaagggccugagagacaacgagaagcaguucaucagcaucaagaccaucagcagcgagcugaccugcagagagggcgagagcuucuggaccagccuguacacccccgugugccugagcagcagaagaugccaccugaugggcgagugcaccggcgacaucugccugaaguggaagagcaacaagaccagcagcgaguucaccggcaaggcccacagcgaggugauccacgagaacaagugcuucgagcagagcggcggcaucggcuacggcugcuucaacgugaaccccagcugccugauggugcacagcuaccugaagcccaucuacaagaacgccuucagaguguucagaugcaucgccuggaaccacagagugagacugggcgugaccacccacaagagaaaguucgagaucacccugauggccaugagcacccagcagaccgacuggggcagcaucggccugauccuggacagcgagggcaucgagggcaccaacgccuacagcuucaugaagcacggccugggcagcuucgccaucguggacgagcccuacagcguggagcccagaaagggcuaccugggcgaggugagaugccccaccgaggagaccgccaucaaggccagccccagcugcaagguggcccccggccugaucgaguaccagcccgagauggacaccguggagugcaccaccaacaugauggaccccauggccaucuucaacagaggcagccugccccaggugagagagggcaagaccuucacccagagcaucgagaagaacagcgugcaggcccugaccaccggcgagauccacgccagcgugagacuggugcuggacgaguacgagaucgaguacaaggugaccagcaacgacugcgacagcaccuucgugaacaucaccggcugcuacagcugcgacgagggcgccagacugugcgugaaggugaagagcagcagcgaggccaucuaccacuucaccgacagcagcuucagcgugaacgugcuguucaaggugacccccagcgugcacgacuacugcaccauccugcacuucagcagacccgugaucagcaucgagggcaaguacgacugcggcaagaacaagaagcccaugcugaucaagggcacccugaucgccauggccccccacgacgacagagugaucaacggcggcagcagcaccguggugaaccccaagggccacggcguggacuuccugggcuggcugagcggccugagcagcugguucggcggcccccugaagaccuuccugauggugaugggcuuccugaugaucggcgugaucaucgugaucgugaccaucauccugaucagaaucggccugcagcaggcccuggccaagaaguucaaguga

SEQ ID NO: 9766 - RNA, 3996 nt, Artificial Sequence
  derived and/or modified CDS sequence (opt4) from Punique virus(PI-B4-2008)__JF920134.1__GP
auguucuacgccaaguucgugaucauccugugccuggugcagggcuucagccugaaguacaccaucaucagcaagcugggcagcggcaccaccagacaggugugccugagccacagcaccgaccuggacaaggugcuggagaucagcaacauggagauggacgccaucaaccugcugggcggcuucugcacccugggcgagcugagaagagaggacugcagccccaacguguucagcaacuacguggugaacgugcacggcaccauccacagcagcaacugcaaguucguggacaucgugggcgacagaagcaucgaggugcugaacgacgccacccccgacagcuucacccccggcgcccacaacugcagcagcuucgagaagccccccuucuggaccgaccuggugcccaagaagaacgacaccgaccccagccccagccugcugagcgugcugcccgccgccgccgagcuggacuucaaccugaagcugaaggaggccaacgacaagguggaggccauccagagagagcugguggccgagaaggccagaagcggcagaaucgaggacgaggccagaaccaagaugagagagcuggaggacgagcugagaagaggcuggaucgccgagagagaggccaaggagcuggcccacaagaaccuggaggaggagagagugagcaagcuggagaucgagagaagaaugcacgaccuggacaagaagcugagacagagcgagaacgacgccgacagacugagagagcaguacaacaagaagagaaagagcgaggaggaggugaagacccccaaggccagcacccugaacgccaccaccacccuggccaccguggugcugaccagccugcuggccaccggccuggccgccaucgagcagaucgaggagagaaacaccaaccacauccugaacagacccggcaccggcguguacauggccagccccacccugacccagaccgagugcagccugggcuacggcaaggagugcaagagcugggagcugcaggugagcccccugcacuaccccuucuucaccagcaacguggacaaguacagcauccuggagagcaucacccaggagcccacccugcugaucaagaacaacaacagcugcgagcugaccaccagccccggcagccagaagcagugccagaaggagagcagcaccaucaagaaguacugcaccgacgacgccagagccuacuucuucaucgaccugggcggcaaccugagcaucgugcacugcagcaacaacuucgugcugagcgaggacugcaacuucugcaucagcaagagcggcggcgugggccagaagaucuucaugcccauccaggacgccuucugccagagaggcggcagcgagagcccccccguggugagauacagcaaggaccugugcagcaucggccuguucaagaucaagagcugccacaagagcaccagcagauacgagagaaugggcuucaucguggccggccagaagaagcuguaccuggaggagcugaagaugagauacagacaggaguacgacgaggaccaguucuucugcuacaaggugaagagcaacagcccccugcaguacgagaaggugagccccagcaagugcaagggcgugggcagccaggaccagaagugcaacggcgacgaguacuucugcaacagauaccccugcgacaccaacaaccccgacgcccacugcagccugagaagacacgccgccgugguggaggugaacgugggcggcguguggaucaagcccaagugcgugggcuacgagaaggugcuggugaagagaggcggccugaagaccgaggaccugagcgugagagagugcaccagcugccugugggagugcgagagaaacaaggugguggugaagacccacggccccaagaucgugagcgccaccgccugcagccacggcagcugcaagagcgugaugcagaagcccagcaccuuccuggagauccccuaccccggcaacagcgagaucaucggcggcgacaucggcauccacaugagcgagagaggcagccccagcaacauccacgugguggugcacugcaagcccaaggacagcugcgacaucagcgacugcaucuucugcaagcacggcauccugaacuaccagugccacagcguggccagcgccgugcugcugagcaccaugaucgccgccugccuggcccuggugggcgugaucgugagcagaagcaagcacgccgugaaguuccuggccagcgugguggccauccccuucaagugggugagccugcugaccguguggguggugaagaacuggaagcugagaaucaccagagugaucagagccaccaacgacgccaucggcugggagaacaaccuggagcaggugagaguggagaacgccgccagaagaccccagcccgccgugagauacgccuucuacggcaccaccauccugagcauccugagcaccggccugugcugcagcgagagccugaucgccgagagcagcaucaugcagugcaccaccgaggacagcagcaccgugugcaaggccaccggcaccguggugcugaagcugggccccaucggcagcgagagcugccugauccugaagggccugagagacaacgagaagcaguucaucagcaucaagaccaucagcagcgagcugaccugcagagagggcgagagcuucuggaccagccuguacacccccgugugccugagcagcagaagaugccaccugaugggcgagugcaccggcgacaucugccugaaguggaagaccaacaagaccagcgccgaguucaccggcaagacccacagcgaggugauccacgagaacaagugcuucgagcagagcggcggcaugggcuacggcugcuucaacgugaaccccagcugccugauggugcacagcuaccugaagcccaucuacaagaacgccuucaagguguucagaugcguggccuggaaccacagagugagacugggcaucaccacccacaagagaaacuucgagaucacccugauggccaugagcacccagcagaccgacuggggcagcaucggccugauccuggacagcgagggcaucaccggcaccaacagcuacagcuucaugaagcacggccugggcagcuucgccaucaucgacgagcccuacgugaccgagcccagaaagggcuaccugggcgaggugagaugccccaccgaggagaccgccgugaaggccagccccagcugcaagguggcccccggccugaucgaguaccagcccgagauggacgugguggagugcaccaccaacaugauggaccccauggccaucuucaacagaggcagccugccccaggugagagacggcaagaccuucacccagagcaucgagaagagcagcgugcaggcccugaccaccggcgagauccacgccagcgugagacuggugcuggacgaguacgagguggaguacaagguggugaacaacgacugcgacagcaccuucgugaacaucaccggcugcuacagcugcgacgagggcgccagacugugcgugaaggugaaggccagcagcgacgugaucuaccacuucaccgacagcgacaacagcaugaacgugcuguucaaggugagcagcaacauccaggacuacugcaucgugcugcacuucagcaagcccguggugaacguggagggcaaguacgacugcggcagaagcaagaagcccaugcugaucaagggcacccugaucgccauggccccccacgacgacagagugaccaacggcggcagcagcaucaucaucaaccccaagggcggcggcguggacuuccugggcuggcugagcggccugagcagcugguucggcggcccccugaagaccuuccugaucaucgccggcuuccugaucgugggcaucaucaucgugaucaucaucaucauccuggccagacugggcauccagcaggcccuggccaagaagcugaaguga

SEQ ID NO: 9767 - RNA, 4020 nt, Artificial Sequence
  derived and/or modified CDS sequence (opt4) from TOSV(9028)__KU904264.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcgaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugagcgagaucgugcccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgagagaaaggcccacgagcuggacaagaugcugaagaagaaggagagagagagccugaucgccaaggagaaggccgacgaggacaugagaagccacgugcacaagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccgugaucaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaagguggagagcugcaagggcgugaccaccagcagcgccagcaagugcagcggcgacgaguacuucugcagcagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccggcagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguuccacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgagcugaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugauccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccggcgugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9768 - RNA, 4020 nt, Artificial Sequence
  derived and/or modified CDS sequence (opt4) from TOSV(A189)__KP694241.1__GP
auguucaucgccaagcugcugcugaucagcugccuggugcagcaggccuaccugaaguacaccaucaucagcgagaucggcaacggcaccagaaccagcagcugcuacagcagcagaaccagccugggcagccugcuggaggccugggacaacaucaccgagagcaucggccugaccagcggcaccugcaaggugggcagccuggagaacagagacugcaagagagacaucaugagcaacuacguggccgaggugcacagcaaccugcacggccugggcgccaugaugcacaacuacggcgacgacaagagaguggaggugcugaacgacgugauccccgacgagcugaaccccggcagacacaacugcagcgaccuggacagaaagcccuucuggaccgaguucaucaacguggccagacccaccaacaagauggcccccaugagcgugauccccccccccaucgugaagcccauccccguggccgagcccaccaucgagaagaccauccccuucgacaagcugcugagcgaggccgagaaggagcugaaccagaccaagaucagacuggaggccgagagaagaagcaacgccgaggaggccgccaaggagagagccagaaugagagagaucgaggacaagcugagaaaggacugggagcuggagagagagagaaaggacgccguggccgacgaccuggccaaggagaucgccagaagaagagagaucgagagaaaggcccacgagcuggacaagaugcugaagaagaaggagagagaggaccugguggccagagagagagugagcgaggacaugagaaaccacgugagaagacccaacaccaccaucgcccccgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccgugcccauccugaacaagagcagcgccgugugcaccaucuaccaccccagaauccacagaauggccugcggcagagaggccagccugaucaagaagaagugcggcagcaacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggaccgagagcauccccaacaccagauacagcaaggaccugugcagcaucggccugcacaccgugaaggagugcaagaccggcaccaccaacuucgagagagugggcuucaucguggugaagggcagaaagauguacaucgagcagaugaagaugagaagcagacaggaguucagcgaggaccaguuccugugcuacaagagcgagagcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcugaugagaggcgccaaggaccuggugaagagacuguucuacuggcugaucaccccccugugcuggcugagcguguucugcagcuggaugaucaagagcuggaagaagagagugggcagcgccaucagcagaaccaacgacaccaucggcuggagagacaacagaagauacggccaggacguggagagagcccaguacaccggcggcgcccccggcgccaaguacagcuucuacggcgugaugauccugggccugcugggcaacgugcacagcugcagcgagagcgugcuggccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugaaguggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacgccuacagcuucaugaagcacggcagcggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccagagcgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcgugcagcaggcccugaagaagaagaacaaguga

SEQ ID NO: 9769 - RNA, 4020 nt, Artificial Sequence
  derived and/or modified CDS sequence (opt4) from TOSV(AR)__EF656362.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagcccagcagcgagaucgugcccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgagagaaaggcccacgagcuggacagaaugcugaagaagaaggagagagagagccugaucgccaaggagaaggccgacgaggacaugagaagccacgugcacaagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccguggugaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaagguggagagcugcaagggcgugaccaccagcagcgccagcaagugcagcggcgacgaguacuucugcaacagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccggcagagagugcgacagcugccugugggagugcggcaaggacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccaaggacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguucuacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggauccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccguguuccacuucaucaacgaggaggagagcaucaacgugaucaacaaggugagccccggcgugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcugggugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9770 - RNA, 4020 nt, Artificial Sequence
  derived and/or modified CDS sequence (opt4) from TOSV(EsPhGR40)__FJ153283.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcggcaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugagcgagaucgcccccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacgccgaggagaccgccagagagagagccagaaugagagacaucgaggaggagcugagaaaggagugggagcuggagagaaagagaaaggacgccauggccgacgaccuggccaaggagaccgccaagagaagagagaucgagagaaaggcccacgagcuggacagaaugcugaagaagaaggagagagagagccugaucgccaaggagaaggaggacgagaacaugagaagcagagugcacaagcccagcaccaccagagcccccgcccccaccaucaucaccacccugcugauggccagcaccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgcccuguucuacaucaaccuggccggccagaucaccguggugaagugcgagaccaaccacgugcugagcagcgacugcggcaacugcaucagcaagagccugagcggccagaagguguacacccccgugcaggacguguucugccagaagggcuggaccgagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaagguggagagcugcaagggcgugaccaccagcagcgccagcaagugcagcggcgacgaguacuucugcagcagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccgagagagagugcgacagcugccugugggagugcggcaagaacaagcugaucgugaagacccacggccccaaggugguguacgccaccgccugcagccacggcagcugcaagagcgugaugcagaagcccaccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguucuacuggcugaucaccccccugugcuggcugagcguguucugcugcuggguggugaagagcuggaagagaagagugggcagcgccaucagcagaaccaacgacaccaucggcuggagagagaacagaagauacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaacgagaccagcgccgaguucaccggcaaggcccacggcgacgugaugcacgagaacaagugcuucgagcagagcggcggcaucggcuacggcugcuucaacgugaaccccagcugccuguacgugcacagcuaccugaagagcguguacagaaacggcuucaagaucuucagaugcguggccuggaaccacagaaucagacuggaggugaccacccagagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccguguuccacuucaucaacgaggaggagagcaucaacgugaucaacaaggugagccccgacgugagcgacuacugcaccgugcugcacuucagcagacccaucaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9771 - RNA, 4014 nt, Artificial Sequence
  derived and/or modified CDS sequence (opt4) from TOSV(SI-121283)__JF330279.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagagugcaagagagacaucaugagcaacuacguggccgaggugcacagcaaccugcacggccugggcgccaugaugcacaacuacggcgacgacaagagaaucgaggugcugaacgacgugauccccgacgagcugaaccccggcagacacaacugcagcgaccuggacagaaagcccuucuggaccgaguucaucaacguggccaagcccgccaacgagauggcccccaugagcgugauccccccccccaucgugaagcccauccccguggccgagagcaccaccaagaagaccauccccuucgacaagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgaggaccuggccaaggagaucgccagaagaagagagaucgagagaaaggcccacgagcuggacaagaugcugaagaagaaggagagagaggaccugguggccagagagagaguggacgaggacaugagaaaccacgugagaagacccaacaccaccaucgcccccaccaucaucaccacccugcugaugggcagcgccgugauggccggcccccuggagaacagagagcccacccaccugcugaacagacccggcaacggcgccuacccccugagcgacuucgccgagcccaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcgacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggagcgagagcauccccagcaccagauacagcaaggaccugugcagcaucggccugcacaccgugaaggagugcaagaucggcaccaccaacuucgagagagugggcuucaucguggugaagggcagaaagauguacaucgagcagaugaagaugagaagcagacaggaguucagcgaggaccaguuccugugcuacaagagcgagggcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcggcuggaugaucagaagcuggaagaagagagugggcagcgccaucagcagaaccaacgacaccaucggcuggagagacaacagcagaagaggccaggacaucgagagagcccaguacaccggcggcgcccccggcgccaaguacagcuucuacggcgugaugauccugggccugcugggcaacgugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugagauggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacgccuacagcuucaugaagcacggccugggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccaguucgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcguggagcaggcccugaagaagaagaacaaguga

SEQ ID NO: 9772 - RNA, 4014 nt, Artificial Sequence
  derived and/or modified CDS sequence (opt4) from TOSV(SI-121487)__JF330280.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagagugcaagagagacaucaugagcaacuacguggccgaggugcacagcaaccugcacggccugggcgccaugaugcacaacuacggcgacgacaagagaaucgaggugcugaacgacgugauccccgacgagcugaaccccggcagacacaacugcagcgaccuggacagaaagcccuucuggaccgaguucaucaacguggccaagcccgccaacgagauggcccccaugagcgugauccccccccccaucgugaagcccauccccguggccgagagcaccaccaagaagaccauccccuucgacaagcugcugagcgaggccgagaaggagcugaaccagaccaagaucaugcuggagaccgagagaagaagcaacgccgaggaggccgccaaggagagagccagaaugagagagaucgaggacaagcugagaaaggacugggagcuggagagagagagaaaggacgccguggccgaggaccuggccaaggagaucgccagaagaagagagaucgagagaaaggcccacgagcuggacaagaugcugaagaagaaggagagagaggaccugguggccagagagagaguggacgaggacaugagaaaccacgugagaagacccaacaccaccaucgcccccaccaucaucaccacccugcugauggccagcgccgugauggccggcccccuggagaacagagagaucaaccaccugcugaacuggcccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcgacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggagcgagagcauccccagcaccagauacagcaaggaccugugcagcaucggccugcacaccgugaaggagugcaagaucggcaccaccaacuucgagagagugggcuucaucguggugaagggcagaaagauguacaucgagcagaugaagaugagaagcagacaggaguucagcgaggaccaguuccugugcuacaagagcgagggcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcggcuggaugaucagaagcuggaagaagagagugggcagcgccaucagcagaaccaacgacaccaucggcuggagagacaacagcagaagaggccaggacaucgagagagcccaguacaccggcggcgcccccggcgccaaguacagcuucuacggcgugaugauccugggccugcugggcaacgugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugagauggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacgccuacagcuucaugaagcacggcagcggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccaguucgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagagcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcgugcagcaggcccugaagaagaagaacaaguga

SEQ ID NO: 9773 - RNA, 4014 nt, Artificial Sequence
  derived and/or modified CDS sequence (opt4) from TOSV(SI-21137)__EU003173.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagagugcaagagagacaucaugagcaacuacguggccgaggugcacagcaaccugcacggccugggcgccaugaugcacaacuacggcgacgacaagagaaucgaggugcugaacgacgugauccccgacgagcugaaccccagaagacacaacugcagcgaccuggacagaaagcccuucuggaccgaguucaucaacguggccaagcccgccaacgagaucgcccccaugagcgugauccccccccccaucgugaagcccauccccguggccgagagcaccaccaagaagaccauccccuucgacaagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgaggaccuggccaaggagaucgccagaagaagagagaucgagagaaaggcccacgagcuggacaagaugcugaagaagaaggagagagaggaccugguggccagagagagaguggacgaggacaugagaaaccacgugagaagacccaacaccaccaucgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcaacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggagcgagaccaaccccagcaccagauacagcaaggaccugugcagcaucggccugcacaccgugaaggagugcaagaucggcaccaccaacuucgagagagagggcuucaucguggugaagggcagaaagauguacaucgagcagaugaagaugagaagcagacaggaguucagcgaggaccaguuccugugcuacaagagcgagggcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcggcuggaugaucagaagcuggaagaagagagugggcagcgccaucagcagaaccaacgacaccaucggcuggagagacaacagcagaagaggccaggacaucgagagagcccaguacaccggcggcgcccccggcgccaaguacagcuucuacggcgugaugauccugggccugcugggcaacgugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugagauggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcggcggcaucaccggcaccaacgccuacagcuucaugaagcacggccugggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccaguucgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcguggagcaggcccugaagaagaagaacaaguga

SEQ ID NO: 9774 - RNA, 4014 nt, Artificial Sequence
  derived and/or modified CDS sequence (opt4) from TOSV(SI-31051)__EU003174.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagagugcaagagagacaucaugagcaacuacguggccgaggugcacagcaaccugcacggccugggcgccaugaugcacaacuacggcgacgacaagagaaucgaggugcugaacgacgugauccccgacgagcugaaccccggcagacacaacugcagcgaccuggacagaaagcccuucugcaccgaguucaucaacguggccaagcccgccaacgagauggcccccaugagcgugauccccccccccaucgugaagcccauccccguggccgagcccaccaccaagaagaccauccccuucgacaagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgaggaccuggccaaggagaucgccagaagaagagagaucgagagaaaggcccacgagcuggacaagaugcugaagaagaaggagagagaggaccugguggccagagagagaguggacgaggacaugagaaaccacgugagaagacccaacaccaccaucgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcgacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggagcgagagcauccccagcaccagauacagcaaggaccugugcagcaucggccugcacaccgugaaggagugcaagaucggcaccaccaacuucgagagagugggcuucaucguggugaagggcagaaagauguacaucgagcagaugaagaugagaagcagacaggaguucagcgaggaccaguuccugugcuacaagagcgagggcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcggcuggaugaucagaagcuggaagaagagagugggcagcgccaucagcagaaccaacgacaccaucggcuggagagacaacagcagaagaggccaggacaucgagagagcccaguacaccggcggcgcccccggcgccaaguacagcuucuacggcgugaugauccugggccugcugggcaacgugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugagauggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcggcggcaucaccggcaccaacgccuacagcuucaugaagcacggccugggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccaguucgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcguggagcaggcccugaagaagaagaacaaguga

SEQ ID NO: 9775 - RNA, 4014 nt, Artificial Sequence
  derived and/or modified CDS sequence (opt4) from TOSV(SI-39538)__EU003175.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagagugcaagagagacaucaugagcaacuacguggccgaggugcacagcaaccugcacggccugggcgccaugaugcacaacuacggcgacgacaagagaaucgaggugcugaacgacgugauccccgacgagcugaaccccggcagacacaacugcagcgaccuggacagaaagcccuucuggaccgaguucaucaacguggccaagcccgccaacgagauggcccccaugagcgugauccccccccccaucgugaagcccauccccguggccgagagcaccaccaagaagaccauccccuucgacaagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgaggaccuggccaaggagaucgccagaagaagagagaucgagagaaaggcccacgagcuggacaagaugcugaagaagaaggagagagaggaccugguggccagagagagaguggacgaggacaugagaaaccacgugagaagacccaacaccaccaucgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcgacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggagcgagagcauccccagcaccagauacagcaaggaccugugcagcaucggccugcacaccgugaaggagugcaagaucggcaccaccaacuucgagagagugggcuucaucguggugaagggcagaaagauguacaucgagcagaugaagaugagaagcagacaggaguucagcgaggaccaguuccugugcuacaagagcgagggcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcggcuggaugaucagaagcuggaagaagagagugggcagcgccaucagcagaaccaacgacaccaucggcuggagagacaacagcagaagaggccaggacaucgagagagcccaguacaccggcggcgcccccggcgccaaguacagcuucuacggcgugaugauccugggccugcugggcaacgugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugagauggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacacgaggugaccacccacagcagaaaguuccccauggugcugauggccaugagcacccagcccaccgacuggggcagcaucggccugauccuggacagcggcggcaucaccggcaccaacgccuacagcuucaugaagcacggccugggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccaguucgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcguggagcaggcccugaagaagaagaacaaguga

SEQ ID NO: 9776 - RNA, 4014 nt, Artificial Sequence
  derived and/or modified CDS sequence (opt4) from TOSV(SI-40463)__EU003176.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagagugcaagagagacaucaugagcaacuacguggccgaggugcacagcaaccugcacggccugggcgccaugaugcacaacuacggcgacgacaagagaguggaggugcugaacgacgugauccccgacgagcugaaccccggcagacacaacugcagcgaccuggacagaaagcccuucuggaccgaguucaucaacguggccaagcccgugaacgagauggcccccaugagcgugauccccccccccaucgugaagcccauccccguggccgagagcaccaccaagaagaccauccccuucgacaagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgaggaccuggccaaggagaucgccagaagaagagagaucgagagaaaggcccacgagcuggacaagaugcugaagaagaaggagagagaggaccugguggccagagagagaguggacgaggacaugagaaaccacgugagaagacccaacaccaccaucgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcgacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggagcgagagcauccccagcaccagauacagcaaggaccugugcagcaucggccugcacaccgugaaggagugcaagaucggcaccaccaacuucgagagagugggcuucaucguggugaagggcagaaagauguacaucgagcagaugaagaugagaagcagacaggaguucagcgaggaccaguuccugugcuacaagagcgagggcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcggcuggaugaucagaagcuggaagaagagagugggcagcgccaucagcagaaccaacgacaccaucggcuggagagacaacagcagaagaggccaggacaucgagagagcccaguacaccggcggcgcccccggcgccaaguacagcuucuacggcgugaugauccugggccugcugggcaacgugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugagauggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcggcggcaucaccggcaccaacgccuacagcuucaugaagcacggccugggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccaguucgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcguggagcaggcccugaagaagaagaacaaguga

SEQ ID NO: 9777 - RNA, 4020 nt, Artificial Sequence
  derived and/or modified CDS sequence (opt4) from TOSV(SI-40614)__EU003177.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagacugcaagagagacaucaugagcaacuacguggccgaggugcacagcaaccugcacggccugggcgccaugaugcacaacuacggcgacgacaagagaguggaggugcugaacgacgugauccccgacgagcugaaccccggcagacacaacugcagcgaccuggacagaaagcccuucuggaccgaguucaucaacguggccaagcccgccaacaagaucgcccccaucagcgugauccccccccccaucgugaagcccauccccaucgccgagagcaccaucaagaagaccauccccuucgacaagcugcugagcgaggccgagaaggagcugaaccagaccaagaucagacuggagaccgagagaagaagcaacgccggcgaggccgccagagagagagccagaaugagagagaucgaggacaagcugagaaagaacugggagcuggagagagagagaaaggacgccguggccgacgaccuggccaaggagaucgccagaagaagagagaucgagagaaaggcccacgagcuggacaagaugcugaagaagaaggagagagaggaccagguggccaucgagagagugagcgaggacaugagaaaccacgugagaagacccaacaccaccaucgcccccgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcaacaacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagagaggcuggaccgagagcauccccagcaccagauacagcaaggaccugugcagcaucggccugcacaccgugaaggagugcaagaccggcgccaccaacuucgagagagugggcuucaucguggugaagagcagaaagauguacaucgagcagaugaagaugagaagcagacaggaguucagcgaggaccaguuccugugcuacaagagcgagagcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagauggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagaagcuguucuacuggcugaucaccccccugugcuggcugagcguguucugcggcuggaugaucaagagcuggaagaagagagugggcagcgccaucagcagaaccaacgacaccaucggcuggagagacaacagaagauacggcagagacguggagagagcccaguacaccggcggcgugcccggcgccaucuacagcuucuacggcgugaugauccugggccugcugggcaacgugcacagcugcagcgagagcgugaucgccgacagcaaggugaugcagugcaccaccagcggcagcagcacccugugcaaggccagcggcaccgugaucaugaagcugggccccaucggcagcgagagcugccugauccugaagggccugaaggacaacgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugaaguggaagaccaacgagaccagccccgaguucaccggcaaggcccacggcgaggugaugcacgagaacagaugcuucgagcagagcggcggcaucggcuacggcugcuucaacgugaaccccagcugccuguacgugcacagcauccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacgccuacagcuucaugaagcacggcagcggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccagagcgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcguggagcaggcccugaagaagaagaacaaguga

SEQ ID NO: 9778 - RNA, 4014 nt, Artificial Sequence
  derived and/or modified CDS sequence (opt4) from TOSV(SI-51903)__EU003178.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagagugcaagagagacaucaugagcaacuacguggccgaggugcacagcaaccugcacggccugggcgccaugaugcacaacuacggcgacgacaagagaaucgaggugcugaacgacgugauccccgacgagcugaaccccggcagacacaacugcagcgaccuggacagaaagcccuucuggaccgaguucaucaacguggccaagcccgccaacgagaucgcccccaugagcgugauccccccccccaucgugaagcccauccccguggccgagagcaccaccaagaagaccauccccuucgacaagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagaagaaggacgccguggccgaggaccuggccaaggagaucgccagaagaagagagaucgagagaaaggcccacgagcuggacaagaugcugaagaagaaggagagagaggaccugguggccagagagagaguggacgaggacaugagaaaccacgugagaagacccaacgccaccaucgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcgacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggagcgagagcauccccagcaccagauacagcaaggaccugugcagcaucggccugcacaccgugaaggagugcaagaucggcaccaccaacuucgagagagugggcuucaucguggugaagggcagaaagauguacaucgagcagaugaagaugagaagcagacaggaguucagcgaggacgaguuccugugcuacaagagcgagggcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcggcuggaugaucagaagcuggaagaagagagugggcagcgccaucagcagaaccaacgacaccaucggcuggagagacaacagcagaagaggccaggacguggagagagcccaguacaccggcggcgcccccggcgccaaguacagcuucuacggcgugaugauccugggccugcugggcaacgugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugagauggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcggcggcaucaccggcaccaacgccuacagcuucaugaagcacggccugggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccaguucgacugcagcgccaccuucaagaaccugaccggcugcuacagcugcgacgagggccccagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcguggagcaggcccugaagaagaagaacaaguga

SEQ ID NO: 9779 - RNA, 4014 nt, Artificial Sequence
  derived and/or modified CDS sequence (opt4) from TOSV(SI-68809)__EU003179.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagagugcaagagagacaucaugagcaacuacguggccgaggugcacagcaaccugcacggccugggcgccaugaugcacaacuacggcgacgacaagagaaucgaggugcugaacgacgugauccccgacgagcugaaccccggcagacacaacugcagcgaccuggacagaaagcccuucuggaccgaguucaucgacguggccaagcccgccaacgagaucgcccccaugagcgugauccccccccccaucgugaagcccauccccguggccgagagcaccaucaagaagaccauccccuucgacaagcugcugagcgaggccgaggaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgaggaccuggccaaggagaucgccagaagaagagagaucgagagaaaggcccacgagcuggacaagaugcugaagaagaaggagagagaggaccugguggccagagagagagugaacgaggacaugagaaaccacgugagaagacccaacaccaccaucgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcaacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggagcgagagcauccccagcaccagauacagcaaggaccugugcagcaucggccugcacaccgugaaggagugcaagaccggcaccaccaacuucgagagagugggcuucaucguggugaagggcagaaagauguacaucgagcagaugaagaugagaagcagacaggaguucagcgaggaccaguuccugugcuacaagagcgagggcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcggcuggaugaucagaagcuggaagagaagagugggcagcgccaucagcagaaccaacgacaccaucggcuggagagacaacagcagaagaggccaggacguggagagagcccaguacaccggcggcgcccccggcgccaaguacagcuucuacggcgugaugauccugggccugcugggcgaggugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugaaguggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcggcggcaucaccggcaccaacgccuacagcuucaugaagcacggccugggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccaguucgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcguggagcaggcccugaagaagaagaacaaguga

SEQ ID NO: 9780 - RNA, 4014 nt, Artificial Sequence
  derived and/or modified CDS sequence (opt4) from TOSV(SI-76082)__EU003180.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagagugcaagagagacaucaugagcaacuacguggccgaggugcacagcaaccugcacggccugggcgccaugaugcacaacuacggcgacgacaagagaaucgaggugcugaacgacgugauccccgacgagcugaaccccggcagacacaacugcagcgaccuggacagaaagcccuucuggaccgaguucaucaacguggccaagcccgccaacgagauggcccccaugagcgugauccccccccccaucgugaagcccauccccguggccgagagcaccaccaagaagaccauccccuucgacgagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgaggaccuggccaaggagaucgccagaagaagagagaucgagagaaaggcccacgagcuggacaagaugcugaagaagaaggagagagaggaccugguggccagagagagaguggacgaggacaugagaaaccacgugagaagacccaacaccaccaucgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcgacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggagcgagagcauccccagcaccagauacagcaaggaccugugcagcaucggccugcacaccgugaaggagugcaagaucggcaccaccaacuucgagagagugggcuucaucguggugaagggcagaaagauguacaucgagcagaugaagaugagaagcagacaggaguucagcgaggaccaguuccugugcuacaagagcgagggcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaugaccccccugugcuggcugagcguguucugcggcuggaugaucagaagcuggaagaagagagugggcagcgccaucagcagaaccaacgacaccaucggcuggagagacaacagcagaagaggccaggacguggagagagcccaguacaccggcggcgcccccggcgccaaguacagcuucuacggcgugaugauccugggccugcugggcaacgugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugagauggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcggcggcaucaccggcaccaacgccuacagcuucaugaagcacggccugggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccaguucgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcguggagcaggcccugaagaagaagaacaaguga

SEQ ID NO: 9781 - RNA, 4020 nt, Artificial Sequence
  derived and/or modified CDS sequence (opt4) from TOSV(TOSV/Mantova.ITA/2013)__KM507329.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagacugcaagagagacaucaugagcaacuacguggccgaggugcacagcaaccugcacggccugggcgccaugaugcacaacuacggcgacgacaagagaguggaggugcugaacgacgugauccccgacgagcugaaccccggcagacacaacugcagcgaccuggacagaaagcccuucuggaccgaguucaucaacguggccaagcccgccaacaagaucgcccccaucagcgugauccccccccccaucgugaagcccauccccaucgccgagagcaccaucaaggagaccauccccuucgagaagcugcugagcgaggccgagaaggagcugaaccagaccaagaucagacuggagaccgagagaagaagcaacgccgaggaggccgccagagagagagccagagugagagagaucgaggacaagcugagaaagaacugggagcuggagagagagagaaaggacgccguggccgacgaccuggccaaggagaucgccagaagaagagagaucgagagaaaggcccacgagcuggacaagaugcugaagaagaaggagagagaggaccagguggccaucgagagagugagcgaggacaugagaaaccacgugagaagacccaacaccaccaucgcccccgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcaacaacaugagcgccuucuucuacgugaaccuggccggccagaucaccguggugaagugcgacaccaaccacgugcugagcaacgacugcggcaacugcuucagcaagacccugagcggccagaagaucuacacccccgugcaggacauguucugccagagaggcuggaccgagagcauccccagcaccagauacagcaaggaccugugcagcaucggccugcacaccgugaaggagugcaagaccggcaccaccaacuucgagagagugggcuucaucguggugaagagcagaaagauguacaucgagcagaugaagaugagaagcagacaggaguucagcgaggaccaguuccugugcuacaagagcgagagcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagauggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagaagcuguucuacuggcugaucaccccccugugcuggcugagcguguucugcggcuggaugaucaagagcuggaagaagagagugggcagcgccaucagcagaaccaacgacaccaucggcuggagagacaacagaagauacggcagagacguggagagagcccaguacaccggcggcgcccccggcgccaaguacagcuucuacggcgugaugauccugggccugcugggcaacgugcacagcugcagcgagagcgugaucgccgacagcaaggugaugcagugcaccaccagcggcagcagcacccugugcaaggccagcggcaccgugaucaugaagcugggccccaucggcagcgagagcugccugauccugaagggccugaaggacaacgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugaaguggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacgccuacagcuucaugaagcacggcagcggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccagagcgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcgugcagcaggcccugaagaagaagaacaaguga

SEQ ID NO: 9782 - RNA, 4020 nt, Artificial Sequence
  derived and/or modified CDS sequence (opt4) from TOSV(TOSV/Phl.233/FR/2009)__HQ184337.1__GP
auguucaucgccaagcugcugcugaucagcugccuggugcagcaggccuaccugaaguacaccaucaucagcgagaccggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugagcgagaucgugcccaugagcgugauccccccccccguggugaagccccagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgagagaaaggcccacgagcuggacaagaugcugaagaagaaggagagagagagccugaucgccaaggagaaggccgacgaggacaugagaagccacgugcacaagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccgugaucaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaaggugcagagcugcaagggcgugaccaccagcagcgccagcaagugcagcggcgacgaguacuucugcagcagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccggcagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguuccacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccggcgugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9783 - RNA, 4020 nt, Artificial Sequence
  derived and/or modified CDS sequence (opt4) from TOSV(TOSV/Phl.51/FR/2009)__HQ184336.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugagcgagaucgugcccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgacagaaaggcccacgagcuggacagaaugcugaagaagaaggagagagagagccugaucgccaaggagaaggccgacgagaacaugagaagccacgugcacgagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccguggugaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaagguggagagcugcaagggcgugaccaccagcagcgccagcaagugcagcggcgacgaguacuucugcagcagauuccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccgagagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguuccacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuucggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugguggaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccagagugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9784 - RNA, 4020 nt, Artificial Sequence
  derived and/or modified CDS sequence (opt4) from TOSV(11368)__KU925897.1__GP
auguucaucgccaagcugcugcugaucagcugccuggugcagcaggccuaccugaaguacaccaucaucagcgagaccggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugagcgagauggugcccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacaccgaggagaccgccaaggagagagccagaaugaaggagaucgaggacgagcugagaagagagugggagcuggagagaaagagaaaggacgccauggccgacgaccuggccaaggagaccgccagaagaagagagaucgagagaaaggcccacgagcuggacaagaugcugaagaagaaggagagagagagccugaucgccaaggagaaggccgacgaggacaugagaagccacgugcacaagcccaacaccaccagagcccuggcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccgugaucaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaaggugcagagcugcaagggcgugaccaccagcagcgccagcaagugcagcggcgacgaguacuucugcagcagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccggcagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguuccacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugauccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccggcgugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9785 - RNA, 4020 nt, Artificial Sequence
  derived and/or modified CDS sequence (opt4) from TOSV(5904242804)__KU935737.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagacugcaagagagacaucaugagcaacuacguggccgaggugcacagcaaccugcacggccugggcgccaugaugcacaacuacggcgacgacaagagaguggaggugcugaacgacgugauccccgacgagcugaaccccggcagacacaacugcagcgaccuggacagaaagcccuucuggaccgaguucaucgacguggccaagcccaccaacaagaucgcccccaugagcgugauccccccccccaucgugaagcccauccccguggccgagagcaccaucaagaagagcauccccuucgacaagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgacgaccuggccaaggagaucgccagaagaagagagaucgagagaaaggcccacgagcuggacaagaugcugaagaagaaggagagagaggaccugguggccagagagagagugagcgaggacaugagaaaccacgugagaaagcccaacaccaccaucgcccccgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcaacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggaccgagagcauccccaacaccagauacagcaaggaccugugcagcaucggccugcacaccgugaaggagugcaagaccggcaccaccaacuucgagagagugggcuucaucgugguggagggcagaaagauguacaucgagcagaugaagaugagaagcagacaggaguucagcgaggaccaguuccugugcuacaagagcgagagcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggaucgugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcggcugggugaucaagagcuggaagaagagagugggcagcgccaucagcagaaccaacgacaccaucggcuggagagacaacagaagauacagacaggacguggagagagcccaguacaccggcggcgcccccggcgccaaguacagcuucuacggcgugauggugcugggccugcugggcaacgugcacagcugcagcgagagcaucaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugaaguggaagaccaacgagaccagcgccgaguucaccggcaaggcccacggcgagguggugcacgagaacagaugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacgccuacagcuucaugaagcacggcagcggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccagagcgacugcagcgccaccuucaagaaccugaccggcugcuacagcugcgacgagggcagcagaaugugcuaccaggugaaggccgagggcgagaccaucuuccacuucaucaacgaggacgagagcaucaacgugaucaacaaggugaaccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugaucgugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcgugcagcaggcccugaagaagaagaacaaguga

SEQ ID NO: 9786 - RNA, 4020 nt, Artificial Sequence
  derived and/or modified CDS sequence (opt4) from TOSV(5963930705)__KU935734.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugggcgagaucgugcccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggaggagcugagaagagagugggagcuggagagaaagagaaaggacgccauggccgacgaccuggccaaggagaccgccagaagaagagagaucgagagaaaggcccacgagcuggacagaaugcugaagaagaaggagagagagagccugaucgccaaggagaaggccgacgaggacaugagaagccacgugcacaagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccguggugaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaagguggagagcugcaagggcgugaccaccagcagcgccagcaagugcagcggcgacgaguacuucugcagcagauaccccugcgaggccgccaacguggaggcccacugcauccugagaagacacagcgccaucguggaggugaacgugaacggcguguggguggugcccagaugcaucggcuacgaggaggugcuggugaagagaaccagccugaagguggaggacaccaccgagagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguuccacuggcugaucaccccccugugcuggcugagcguguucugcugcuggauggugaagagcuggaagagaagagugggcagcgccaucagcagaaccaacgacaccaucggcuggagagagaacagaagacacgcccaggacaucgagagagcccagcacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccggcgugagcgacuacugcaccgugcugcacuucagcagccccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9787 - RNA, 4020 nt, Artificial Sequence
  derived and/or modified CDS sequence (opt4) from TOSV(H4906)__KU922125.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugagcgagaucgugcccaugagcgugauccccccccccguggugaagccccagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgagagaaaggcccacgagcuggacagaaugcugaagaagaaggagagagagagccugaucgccaaggagaaggccgacgaggacaugagaagccacgugcacaagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccguggugaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaagguggagagcugcaagggcgugaccaccagcagcgccagcaagugcagcggcgacgaguacuucugcagcagauuccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccgagagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguuccacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggagaugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugaaccccggcgugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9788 - RNA, 4020 nt, Artificial Sequence
  derived and/or modified CDS sequence (opt4) from TOSV(MRS2010-4319501)__KC776215.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaucagcggcaccugcaaggugggcagccuggagaacagagacugcagaaaggacaucaugagcaacuacguggccgaggugcacagcaaccugcacggccugggcgccaugaugcacaacuacgccgacgacaagagaguggagauccugaacgacgugauccccgacgagcugaaccccggccaccacaacugcagcgaccuggacagaaagcccuucuggaccgaguucaucaacguggccaagccccugagcgagaucgugcccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgagagaaaggcccacgagcuggacagaaugcugaagaagaaggagagagagagccugaucgccaaggagaaggccgacgaggacaugagaagccacguguacaagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccguggugaagugcgagaccaaccacgugcugagcagcgacugcggcaacugcaucagcaagagccugagcggccagaagguguacacccccgugcaggacguguucugccagaagggcuggacccagagcauccccagcaccaaguacagcaaggacaucugcagcaucggccugcacaccgugaaggagugcaagaucggcaucaccagcuucgagagagugggcuucaucguggugaagggcagaaagauguacaucgagcagaugaagaugagaagcagacaggaguacagcgaggaccaguuccugugcuacaagagcgagagcagcagcggcagcagcgugaagcugaagaaguucaagguggagagcugcaagggcgugaccaccagcagcgccagcaagugcagcggcgacgaguacuucugcagcagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccggcagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguuccacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagagugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcgugaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccggcgugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9789 - RNA, 4020 nt, Artificial Sequence
  derived and/or modified CDS sequence (opt4) from TOSV(Nice/113)__KU204982.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcggcaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccagaccccugagcgagaucgcccccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgagagaaaggcccacgagcuggacagaaugcugaagaagaaggagagagagagccugaucgccaaggagaaggccgacgaggacaugagaagccacgugcacaagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccguggugaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugggcggcagaaagauguacaucgagcagaugaagaugagaagcagacaggaguacagcgaggaccaguuccugugcuacaagagcgagagcggcagcggcagcagcgugaagcugaagaaguucaagguggagagcugcaagggcgugaccaccagcagcgccagcaagugcagcggcgacgaguacuucugcagcagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccgagagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguucuacuggcugaucaccccccugugcuggcugagcguguucugcugcugggugaucaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccgaggugagcaacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9790 - RNA, 4020 nt, Artificial Sequence
  derived and/or modified CDS sequence (opt4) from TOSV(P233)__KU204976.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugagcgagaucgugcccaugagcgugauccccccccccguggugaagccccagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgagagaaaggcccacgagcuggacaagaugcugaagaagaaggagagagagagccugaucgccaaggagaaggccgacgaggacaugagaagccacgugcacaagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccgugaucaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaaggugaagagcugcaagggcgugaccaccagcagcgccagcaagugcagcggcgacgaguacuucugcagcagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccggcagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguuccacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccggcgugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9791 - RNA, 4020 nt, Artificial Sequence
  derived and/or modified CDS sequence (opt4) from TOSV(T152)__JX867535.1__GP
auguucaucgccaagcugcugcugaucagcugccuggugcagcaggccuaccugaaguacaccaucaucagcgagaucggcaacggcaccagaaccagcagcugcuacagcagcagaaccagccugggcagccugcuggaggccugggacaacaucaccgagagcaucggccugaccagcggcaccugcaaggugggcagccuggagaacagagacugcaagagagacaucaugagcaacuacguggccgaggugcacagcaaccugcacggccugggcgccaugaugcacaacuacggcgacgacaagagaguggaggugcugaacgacgugauccccgacgagcugaaccccggcagacacaacugcagcgaccuggacagaaagcccuucuggaccgaguucaucaacguggccaagcccaccaacaagaucgcccccaucagcgugauccccccccccaucgugaagcccauccccaucgccgagcccaccaccaagaagaacauccccuucgacaagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgacgaccuggccaaggagaucgccagaagaagagagaucgagagaaaggcccacgagcuggacaagaugcugaagaagaaggagagagaggaccugguggccaucgagaaggugagcgaggacaugagaaaccacgugagaagacccaacaccaccaucgcccccgcccccaccaucaucaccacccugcugcuggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcaacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggaccgagagcauccccagcaccagauacagcaaggaccugugcagcaucggccugcacaccgugaaggagugcaagaccggcaccaccaacuucgagagagugggcuucaucgugguggagagcagaaagauguacaucgagcagaugaagaugagaagcagacaggaguucagcgaggaccaguuccugugcuacaagagcgagagcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggguggugcccagaugcaucggcuacgaggaggugcuggugagaagaaccagccugaagguggaggacaccagcagcagagagugcgacaccugccugugggagugcggcaagaacaagcugaucgugaagacccacggccccaagaucguguacgccaccgccugcagccacggcagcugcaagagcgugaugcagaagcccgccaccuucguguuccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcuggugaagggcgccaaggaccuggugaagagacuguucuacuggcugaucaccccccugugcuggcugagcguguucugcagcuggaugaucaagagcuggagaaagagagugggcagcgccaucagcagaaccaacgacaccaucggcuggagagacaacagaagauacggccaggacguggagagagcccaguacaccggcggcgcccccggcaccaaguacagcuucuacggcgugaugauccugggccugcugggcaacgugcacagcugcagcgagagcgugaucgccgacagcaaggugaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugaaguggaagaccaacgagaccagcgccgaguucaccggcaaggcccacggcgaggugaugcacgagaacaagugcuucgagcagagcggcggcaucggcuacggcugcuucaacgugaaccccagcugccuguacgugcacagcuaccugaagagcguguacaagaacggcuucaagaucuucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacgccuacagcuucaugaagcacggcagcggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccagagcgacugcagcgccaccuucaagaaccugaccggcugcuacagcugcgacgagggcagcagaaugugcuaccaggugaaggccgagggcgagaccaucuuccacuucgugaacgaggacgagagcaucaacgugaucaacaaggugagccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugguggugaaccccaagggcggcaccguggacuucuucggcugggugagcggccugaccagcuggcugggcggcccccugaagaccuuccugaccauccugggcuuccuggcccugggccugcugcuggugguggugaucaucaucaucgccagaaccggcgugcagcaggcccugaagaagaagaacaaguga

SEQ ID NO: 9792 - RNA, 4020 nt, Artificial Sequence
  derived and/or modified CDS sequence (opt4) from TOSV(TOSV/P51)__KU204979.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugagcgagaucgugcccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgacagaaaggcccacgagcuggacagaaugcugaagaagaaggagagagagagccugaucgccaaggagaaggccgacgagaacaugagaagccacgugcacgagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccguggugaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaagguggagagcugcaagggcgugaccaccagcagcgccagcaagugcagcggcgacgaguacuucugcagcagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccggcagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguucuacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugguggaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugacccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccagagugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9793 - RNA, 4020 nt, Artificial Sequence
  derived and/or modified CDS sequence (opt4) from TOSV(TOSV_Italy/BB8/2014/human)__KY626661.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacaucaccgagagcaucggccugaccagcggcaccugcaaggugggcagccuggagaacagagacugcaagagagacaucaugagcaacuacguggccgaggugcacagcaaccugcacggccugggcgccaugaugcacaacuacggcgacgacaagagaguggaggugcugaacgacgugauccccgacgagcugaaccccggcagacacaacugcagcgaccuggacagaaagcccuucuggaccgaguucaucgacguggccaagcccaccaacaagaucgcccccaugagcgugauccccccccccaucgugaagcccauccccguggccgagagcaccaucaagaagagcauccccuucgacaagcugcugagcgaggccgagaaggagcugaaccagaccaagaucagacuggagaccgagagaagaagcaacgccgaggaggccgccaaggagagagccagaaugagagagaucgaggacaagcugagaaaggacugggagcuggagagagagagaaaggacgccguggccgacgaccuggccaaggagaucgccagaagaagagagaucgagagaaaggcccacgagcuggacaagaugcugaagaagaaggagagagaggaccugguggccagagagagagugagcgaggacaugagaaaccacgugugcaagcccaacaccaccaucgcccccgcccccaccaucaucaccacccugcugauggccagcgccgugauggccggcccccuggagaacagagagaccaaccaccugcugaacagacccggcaacggcgccuacacccugagcgacuucgccgagagcaccugcacccuggccuacggcagcgagugcaagagcugggagcaccagcuggacgagcugagcuuccccuucuuccacagcaaccuggacaaguacagcaugcuggaggccgccaccgagaccauccccauccugaacaagagcagcgccgugugcaccaucagccccagcacccacagcagcaacgccugcggcagagaggccagccugaucaagaagaagugcggcagcaacaugagcgccuucuucuacgugaaccuggccggccagaucaccguggugaagugcgacaccaaccacgugcugagcaacgacugcggcaacugcaucagcaagacccugagcggccagaagaucuacacccccgugcaggacauguucugccagaagggcuggaccgagagcauccccaacaccagauacagcaaggaccugugcagcaucggccugcacagcgugaaggagugcaagaccggcaccaccaacuucgagagagugggcuucaucguggugaagggcagaaagauguacaucgagcagaugaagaugagaagcagacaggaguucagcgaggaccaguuccugugcuacaagagcgagagcagcagcggcagcagcgugaagcugaagaaggugaagguggagagcugcaagggcgugaccaccagcagcgccagcaagugcagcggcgacgaguacuucugcagcagauaccccugcgagaccgccaacguggaggcccacugcauccugagaagacacagcgccgugaucgaggugaacgugaacggcguguggaucgugcccagaugcaucggcuacgaggaggugcuggugagaagaaccagccugaagguggaggacaccagcagcagagagugcgacaccugccugugggagugcggcaaggacaagcugaucgugaagacccacggccccaagaucguguacgccaccgccugcagccacggcagcugcaagagcgugaugcagaagcccgccaccuucguguaccugcccuaccccggcaacagcgagaucgugggcggcgacaucggcgugcacaugaccgaggagagcagccccagcaacauccacaugguggcccacugccccgccaaggacagcugcgaggugagcagcugccuguucugcgugcacggccugcugaacuaccagugccacacccuguucagcgcccugcugaucagcaccaccgugaugagcauccugacccugcugcugcugcugaugaagggcgccaaggaccuggugaagagacuguucuacuggcugaucaccccccugugcuggcugagcguguucugcggcugggugaucaagagcuggaagaagagagugggcagcgccaucagcagaaccaacgacaccaucggcuggagagacaacagaagauacagacaggacguggagagagcccaguacaccggcggcgcccccggcgccaaguacagcuucuacggcgugauggugcugggccugcugggcaacgugcacagcugcagcgagagcgugaucgccgacagcaagaucaugcagugcaccaccagcggcagcagcacccugugcaaggccagcggcaccgugaucaugaagcugggccccaucggcagcgagagcugccugauccugaagggccugaaggacagcgagaagcaguucaucagcaucaagaccaucagcagcgagcugaccugcagagagggcgagagcuucuggaccacccuguacacccccgugugccugagcagcagaagaugccaccugaugggcgagugcgugagcgacagaugccugaaguggaagaccaacgagaccagcgccgaguucaccggcaaggcccacggcgaggugaugcacgagaacagaugcuucgagcagagcggcggcaucggcuacggcugcuucaacgugaaccccagcugccuguacgugcacagcuaccugaagagcguguacaagaacggcuucaagaccuucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacgccuacagcuucaugagacacggcagcggcagcuucgccaucaucgacgaccccuacagccccgagcccagaaagggcuuccugggcgaggugagaugccccaccgaggagaccgccaucagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugagagccagcaucagacugacccuggacgacuacgacgugguguaccagaacagccagagcgacugcagcgccaccuucaagaaccugaccggcugcuacagcugcgacgagggcagcagaaugugcuaccaggugaaggccgagggcgagaccaucuuccacuucaucaacgaggacgagagcaucaacgugaucagcaaggugaaccccgacgugagcgacuacugcaccgugcugcacuucagcagacccgugaucagcaucgagggcagauacgacugcggccugagcaagagacccauggugaucaagggcacccugaucgccaccgccccccacgacgacagaaagcacgagggcggcagcagccugaucgugaaccccaagggcggcaccguggacuucuucggcugggugagcggccugaccagcuggcugggcggcccccugaagaccuuccugaccauccugggcuuccuggcccugggccugcugcugguggugaucaucaucaucaucgccagaaccggcgugcagcaggcccugaagaagaagaacaaguga

SEQ ID NO: 9794 - RNA, 4020 nt, Artificial Sequence
  derived and/or modified CDS sequence (opt4) from TOSV(TOSV-54441132704)__KX010933.1__GP
auguucaucgccaagcugcugcugaucagcugccuggugcagcaggccuaccugaaguacaccaucaucagcgagaucggcaacggcaccagaaccagcuucugcuacagcagcagaaccagccugggcagccugcuggaggccugggacaacgugaccgagagcaucggccugaccagcggcaccugcaaggugggcagccuggagaacagagacugcagaaaggacaucaugagcaacuacguggccgaggugcacagcaaccugcacggccugggcgccaugaugcacaacuacggcgacgacaagagaguggagauccugaacgacgugauccccgacgagcugaaccccggccaccacaacugcagcgaccuggacagaaagcccuucuggaccgaguucaucaacguggccaagccccugagcgagaucgugcccaugagcgugauccccccccccguggugaagcugcagccccccgccgagcccagcagcaagaagcacgugcccuucgacgugcugcugagcgaggccgagaaggagcugaaccagaccaagaucagacuggaggacgagagaaagagcaacgccgaggagaccgccaaggagagagccagaaugaaggagaucgaggacgagcugagaagagagugggagcuggagagaaagagaaaggacgccauggccgacgaccuggccaaggagaccgccagaagaagagagaucgagagaaaggcccacgagcuggacaagaugcugaagaagaaggagagaaagagccugaucgccaaggagaaggccgacguggacaugagaagccacgugcacaagcccaacaccaccagagcccccgcccccaccaucaucaccacccugcugauggccagcgccgcccuggccggcccccuggagaacagagagaccaaccaccugcugaacagacccggcaacggcgccuacacccugagcgacuucgccgagagcaccugcacccuggccuacggcagcgagugcaagagcugggagcaccugcugaacgaggagcuguuccccuucuuccacagcaaccuggacaaguacagcaugcuggaggccgccaccgagaccgugcccauccugaacaagagcagcgccgugugcaccaucagccccagcacccacagcagcaacgccugcggcagagaggccagcgugaucagaaagaagugcuacagcaacaugagcgccuucuucuacaucaaccuggccggccagaucaccgugaucaagugcgagaccaaccacgugcugagcagcgacugcggcaacugcaucagcaagagccugagcggccagaagguguacacccccgugcaggacguguucugccagaagggcuggacccagagcauccccagcaccagauacagcaaggacaucugcagcaucggccugcacaccgugaaggagugcaagaucggcaccaccagcuucgagagagugggcuucaucguggugaagggcagaaagauguacaucgagcagaugaagaugagaagcagacaggaguacagcgaggaccaguuccugugcuacaagagcgagagcggcagcggcagcagcgugaagcugaagaaguucaagguggagagcugcaagggcgugaccaccagcagcgccagcaagugcagcggcgacgaguacuucugcagcagauaccccugcgagaccgccaacguggaggcccacugcauccugagaagacacagcgccaucguggaggugaacgugaacggcguguggguggugcccagaugcaucggcuacgaggaggugcuggugaagagaaccagccugaagguggaggacaccaccggcagagagugcgacagcugccugugggagugcggcaagaacaagcugaucgugaagacccacggccccaaggugguguacgccaccgccugcagccacggcagcugcaagagcgugaugcagaagcccgccaccuucguguaccugcccuaccccggcaacagcgagaucgugggcggcgacaucggcauccacaugaccgaggagagcagccccagcaacauccaccugguggcccacugccccgccagagacagcugcgacgugagcgacugccuguucugcgugcacggccugcugaacuaccagugccacacccuguucagcgcccugcugaucagcaccaccgugaugagcauccugacccugcugcugcugcuggugaagggcgccaaggaccuggugaagaagcuguucuacuggcugaucaccccccugugcuggcugagcguguucugcugcuggguggugaagagcuggaagagaagagugggcagcgccaucagcagaaccaacgacaccaucggcuggagagagaacagaagacacgcccaggacaucgagagagcccaguacaccggcggcgcccccggcgccaaguacagcuucuacggcgugaugauccugggccugcugagcagcgcccagagcugcagcgagagcgugaucgccgacagcaagaucaugcagugcaccaccagcggcagcagcacccugugcaaggccagcggcaccgugaucaugagacugggccccaucggcagcgagagcugccugauccugaagggccugaaggacagcgagaagcaguucaucagcaucaagaccaucagcagcgagcugaccugcagagagggcgagagcuucuggaccacccuguacacccccaucugccugagcagcagaagaugccaccugaugggcgagugcgugagcgacagaugccugaaguggaagaccaaccagaccagcgccgaguucaccggcaaggcccacggcgacgugaugcacgagaacagaugcuucgagcagagcggcggcaucggcuacggcugcuucaacgugaaccccagcugccuguacgugcacagcuaccugaagagcguguacagaaacggcuucaagguguucagaugcguggccuggaaccacagaaucagacuggaggugaccacccacagcagaaaguuccccauggugcugauggccaugagcacccagcccaccgacuggggcagcaucggccugauccuggacagcgagggcaucaccggcaccaacagcuacagcuucaugaagcacggcagcggcagcuucgccaucaucgacgaccccuacagccccgagcccagaaagggcuuccugggcgaggugagaugccccaccgaggagaccgccaugagagccagccccagcugcaagauggcccccaaccugaucgaguaccagcccgagauggacaccgccgagugcaccaccaacaugaucgaccccauggccaucuucaacagaggcagccugccccaggugagagacggcaugaccuucacccagagcaucgagaagaacaccgugcaggcccugaccaccggcgaggugaaggccagcaucagacugauccuggacgacuacgacgugguguaccagaacagccagagcgacugcagcgccaccuucaagaaccugaccggcugcuacagcugcgacgagggcagcagacugugcuaccaggugaaggccgagggcgagaccaucuuccacuucaucaacgaggaggagagcaucaacgugaucaacaaggugagccccggcgugagcgacuacugcaccgugcugcacuucagcagacccgugaucagcaucgagggcaccuacgacugcggccugagcaagagacccauggugaucaagggcacccugaucgccaccgccccccacgacgacagaaagcacgagggcggcagcagccugguggugaaccccaagggcggcagcguggacuucuucggcuggcugagcggccugaccagcuggcugggcggcccccugaagaccuuccugaccauccugggcuuccuggccgugggccugcugcugguggugaucaucaucaucaucaucagaaccggcaugcagcaggcccugaagaagaagaucaaguga

SEQ ID NO: 9795 - RNA, 3222 nt, Artificial Sequence
  derived and/or modified CDS sequence (opt4) from SFTSV(HB29)__NC_018138.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaccagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagacugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9796 - RNA, 3222 nt, Artificial Sequence
  derived and/or modified CDS sequence (opt4) from SFTSV(Jilin)__KT890281.1__GP
augaugaaggugaucugguucagcagccugaucugccuggugauccagugcggcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccccccuggaggugaacccccccgagcagagaaucggccagugcaccggcugccaccuggagugcaucaacggcggcgugagacugaucacccugaccagcgagcugaagagcgccaccgugugcgccuaccacuucugcagcugcgccaccagcggcaagaagagcaccgagauccaguuccacagcggcagccuggugggcaagaccgccauccacgugaagggcgcccugguggacggcaccgaguucaccuucgagggcagaugcauguuccccgacggcugcgacgccguggacugcaccuucugcagagaguuccugaagaacccccagugcuaccccgcccagaaguggcuguucaucaucaucgugauccugcugggcuacgccggccugaugcugcugaccaacgugcugaaggccaugggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccagaccaucguggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucagagugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9797 - RNA, 3222 nt, Artificial Sequence
  derived and/or modified CDS sequence (opt4) from SFTSV(05-Lu'an(CHN)-2015)__KX302597.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcggcgccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcuaccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9798 - RNA, 3222 nt, Artificial Sequence
  derived and/or modified CDS sequence (opt4) from SFTSV(07-Lu'an(CHN)-2015)__KX302598.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9799 - RNA, 3222 nt, Artificial Sequence
  derived and/or modified CDS sequence (opt4) from SFTSV(12-Lu'an(CHN)-2014)__KX302595.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagguggacggcaucguguucaaccagugcgacagcgagagccugccccagcccaucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugauggcccccgugaagcugauguucgccaucaugaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagcuacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcagaggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcgugcuggcccuguucuuccugaucaugagccuguucaagcugggcaccaagcaggugaucagaagcagaaccaagcuggccuga

SEQ ID NO: 9800 - RNA, 3222 nt, Artificial Sequence
  derived and/or modified CDS sequence (opt4) from SFTSV(14-Lu'an(CHN)-2014)__KX302596.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagguggacggcaucguguucaaccagugcgacagcgagagccugccccagcccaucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugauggcccccgugaagcugauguucgccaucaugaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcagaggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcgugcuggcccuguucuuccugaucaugagccuguucaagcugggcaccaagcagguguucagaagcagaaccaagcuggccuga

SEQ ID NO: 9801 - RNA, 3222 nt, Artificial Sequence
  derived and/or modified CDS sequence (opt4) from SFTSV(18-Lu'an(CHN)-2015)__KX302599.1__GP
augaugaaggugaucugguucuucagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacagaggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacgugaaggagugcgugaccaccggcagagcccugcugcccgccgugaaccccggccaggaggccugccugcacuucaccgcccccggcagccccgacagcaagugccugaagaucagagugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcaucaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9802 - RNA, 3222 nt, Artificial Sequence
  derived and/or modified CDS sequence (opt4) from SFTSV(27-Lu'an(CHN)-2015)__KX302600.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9803 - RNA, 3222 nt, Artificial Sequence
  derived and/or modified CDS sequence (opt4) from SFTSV(36-Lu'an(CHN)-2015)__KX302601.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccguggugcugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9804 - RNA, 3222 nt, Artificial Sequence
  derived and/or modified CDS sequence (opt4) from SFTSV(42-Lu'an(CHN)-2015)__KX302602.1__GP
augaugaaggugaucugguucagcagccugaucugcuucgugauccagugcagcggcgacagcggccccaucaucugcgccggccccauccacagcaacaagagcgccgacaucccccaccugcugggcuucagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcagaaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccgugagcaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9805 - RNA, 3222 nt, Artificial Sequence
  derived and/or modified CDS sequence (opt4) from SFTSV(44-Lu'an(CHN)-2015)__KX302603.1__GP
augaugaaggugaucugguucagcagccugaucugcuucgugauccagugcagcggcgacagcggccccaucaucugcgccggccccauccacagcaacaagagcgccgacaucccccaccugcugggcuucagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccgugagcaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9806 - RNA, 3222 nt, Artificial Sequence
  derived and/or modified CDS sequence (opt4) from SFTSV(52-Lu'an(CHN)-2015)__KX302604.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagagaagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9807 - RNA, 3222 nt, Artificial Sequence
  derived and/or modified CDS sequence (opt4) from SFTSV(HL/Injected)__KF791953.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9808 - RNA, 3222 nt, Artificial Sequence
  derived and/or modified CDS sequence (opt4) from SFTSV(HL/Larvae/G2)__KF791955.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcagaaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9809 - RNA, 3222 nt, Artificial Sequence
  derived and/or modified CDS sequence (opt4) from SFTSV(JS2011-004)__KC505124.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcggcggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaugaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccacgugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9810 - RNA, 3222 nt, Artificial Sequence
  derived and/or modified CDS sequence (opt4) from SFTSV(JS2011-013-1)__KC505127.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaaguacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcggccacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9811 - RNA, 3222 nt, Artificial Sequence
  derived and/or modified CDS sequence (opt4) from SFTSV(JS2011-027)__KC505130.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacgagcccgagcagagaaucggccagugcaccggcugccaccuggagugcaucagcggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaugggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcaucaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9812 - RNA, 3222 nt, Artificial Sequence
  derived and/or modified CDS sequence (opt4) from SFTSV(JS2011-034)__KC505133.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccuuccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcugcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccugcugaagcugggcaccaagcagguguacagaagcagaaccaagcuggccuga

SEQ ID NO: 9813 - RNA, 3222 nt, Artificial Sequence
  derived and/or modified CDS sequence (opt4) from SFTSV(JS2011-062)__KC505136.1__GP
augaugaaggugaucugguucagcagccugaucugccuggugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgugaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccugaugggcaagcugaucgacagaggcagacaggugauccacgaggagaucggcgagaacggcgagggcaacagagacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggccugaucggcgugcugcugggcggccuggcccuguucuuccugaucaugagccuguucaagcugggcaccaagcagguguucagaagcagaaccaagcuggccuga

SEQ ID NO: 9814 - RNA, 3222 nt, Artificial Sequence
  derived and/or modified CDS sequence (opt4) from SFTSV(JS2011-109)__KC505139.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccacgugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9815 - RNA, 3222 nt, Artificial Sequence
  derived and/or modified CDS sequence (opt4) from SFTSV(JS2011-13-2)__KR230770.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccacgugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9816 - RNA, 3222 nt, Artificial Sequence
  derived and/or modified CDS sequence (opt4) from SFTSV(JS2011-69)__KR230771.1__GP
augaugaaggugaucugguucagcagccuggugugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgacagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugauggcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccgugagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcgugcuggcccuguucuuccugaucaugagccuguucaagcugggcaccaagcagguguucagaagcagaaccaagcuggccuga

SEQ ID NO: 9817 - RNA, 3222 nt, Artificial Sequence
  derived and/or modified CDS sequence (opt4) from SFTSV(JS2012-020)__KC505142.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcggcggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugggccccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucaucauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugagcuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccacgugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9818 - RNA, 3222 nt, Artificial Sequence
  derived and/or modified CDS sequence (opt4) from SFTSV(JS2012-035)__KC505145.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccugggcgugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccacgugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9819 - RNA, 3222 nt, Artificial Sequence
  derived and/or modified CDS sequence (opt4) from SFTSV(JS2012-79)__KR230772.1__GP
augaugaaggugaucugguucagcagccugaccugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugagcgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcggccacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9820 - RNA, 3222 nt, Artificial Sequence
  derived and/or modified CDS sequence (opt4) from SFTSV(JS2013-44)__KR230773.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggagaccagcgaggccaagugcagaugcagccuggugcacaagcccggcgaggugguggugagcuacggcggcaugagaaucagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucagcgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucagcaugaucaugagccuguucaagcugggcaccaagcagguguucagaagcagaaccaagcuggccuga

SEQ ID NO: 9821 - RNA, 3222 nt, Artificial Sequence
  derived and/or modified CDS sequence (opt4) from SFTSV(JS2013-46)__KR230774.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacgagcccgagcagagaaucggccagugcaccggcugccaccuggagugcaucagcggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaugggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucauggcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcaucaacuacagaggccugagacugagccugagcgagaucagcgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9822 - RNA, 3222 nt, Artificial Sequence
  derived and/or modified CDS sequence (opt4) from SFTSV(JS2013-52)__KR230775.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccuuccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcgugcuggcccuguucuuccugaucaugagccuguucaagcugggcaccaagcagguguucagaagcagaaccaagcuggccuga

SEQ ID NO: 9823 - RNA, 3222 nt, Artificial Sequence
  derived and/or modified CDS sequence (opt4) from SFTSV(JS2013-69)__KR230776.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaucaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucacccuggagagcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcgugcuggcccuguucuuccugaucaugagccuguucaagcugggcaccaagcagguguucagaagcagaaccaagcuggccuga

SEQ ID NO: 9824 - RNA, 3222 nt, Artificial Sequence
  derived and/or modified CDS sequence (opt4) from SFTSV(JS2013-71)__KR230777.1__GP
augaugaaggugaucugguucagcagccugaucugcuucgugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccacgugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9825 - RNA, 3222 nt, Artificial Sequence
  derived and/or modified CDS sequence (opt4) from SFTSV(JS2014-03)__KR230778.1__GP
augaugaaggugaucugguucagcagccugaucuacuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccuuccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcagagugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9826 - RNA, 3222 nt, Artificial Sequence
  derived and/or modified CDS sequence (opt4) from SFTSV(JS2014-16)__KR230780.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagguggacggcaucguguucaaccagugcgacagcgagagccugccccagcccaucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugauggcccccgugaagcugauguucgccaucaucaagaagcugaugagaagcgugagcugcaugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugcugugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcagaggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcgugcuggcccuguucuuccugaucaugagccuguucaagcugggcaccaagcagguguucagaagcagaaccaagcuggccuga

SEQ ID NO: 9827 - RNA, 3222 nt, Artificial Sequence
  derived and/or modified CDS sequence (opt4) from SFTSV(JS2014-18)__KR230781.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaccacccccauccccgaggagaccuuccuggagcugaagagcuucagccagagcgaguuccccgacgugugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9828 - RNA, 3222 nt, Artificial Sequence
  derived and/or modified CDS sequence (opt4) from SFTSV(JS2014-31)__KR230782.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcgugcuggcccuguucuuccugaucaugagccuguucaagcugggcaccaagcagguguucagaagcagaaccaagcuggccuga

SEQ ID NO: 9829 - RNA, 3222 nt, Artificial Sequence
  derived and/or modified CDS sequence (opt4) from SFTSV(JS2014-33)__KR230783.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcaacugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagagccgugggcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcggcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcgccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcaggccuucagaagcagaaccaagcuggccuga

SEQ ID NO: 9830 - RNA, 3222 nt, Artificial Sequence
  derived and/or modified CDS sequence (opt4) from SFTSV(JS2014-39)__KR230784.1__GP
augaugaaggugaucugguucagcagccugaccugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggagaccagcgaggccaagugcagaugcagccuggugcacaagcccggcgaggugguggugagcuacggcggcaugagaaucagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucagcgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucagcaugaucaugagccuguucaagcugggcaccaagcagguguucagaagcagaaccaagcuggccuga

SEQ ID NO: 9831 - RNA, 3222 nt, Artificial Sequence
  derived and/or modified CDS sequence (opt4) from SFTSV(JS2014-H.longicornis-02)__KR230786.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccguggaggccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugccccgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9832 - RNA, 3222 nt, Artificial Sequence
  derived and/or modified CDS sequence (opt4) from SFTSV(JS2014-H.longicornis-03)__KR230787.1__GP
augaugaaggugaucugguucagcagccugaccugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccuuccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9833 - RNA, 3222 nt, Artificial Sequence
  derived and/or modified CDS sequence (opt4) from SFTSV(JS2014-Hedgehog-02)__KR230789.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9834 - RNA, 3222 nt, Artificial Sequence
  derived and/or modified CDS sequence (opt4) from SFTSV(KACNH)__KU507558.1__GP
augaugaaggugaucugguucagcagccugaucugccuggugauccagugcagcggcgacagcggccccaucaucugcgccggccccauccacagcaacaagagcgccagcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgacgccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucauccugaucgugauccugcugggcuacgccggccugaugcugaucaccaacgugcugaaggccaucggcguguggggcagcugggugaucgcccccgugaagcugauguucgccaucaucaagaagcugaugagaaccgugagcugccugaugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9835 - RNA, 3222 nt, Artificial Sequence
  derived and/or modified CDS sequence (opt4) from SFTSV(KACNH2)__KU507559.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagagaaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccacaucgagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcggcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcauccacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9836 - RNA, 3222 nt, Artificial Sequence
  derived and/or modified CDS sequence (opt4) from SFTSV(KACNH3)__KP663744.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcggcgccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgaggugaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9837 - RNA, 3222 nt, Artificial Sequence
  derived and/or modified CDS sequence (opt4) from SFTSV(KADGH)__KU507548.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccuggcccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggagaccagcguggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucagcggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgugcugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucagacugcacagcagcaagaacagcaccgcccacgugagaugcaaggaggacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9838 - RNA, 3222 nt, Artificial Sequence
  derived and/or modified CDS sequence (opt4) from SFTSV(KAGBH)__KU507560.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaucagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9839 - RNA, 3222 nt, Artificial Sequence
  derived and/or modified CDS sequence (opt4) from SFTSV(KAGBH3)__KU507561.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggagaccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagaaucaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugcugugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacgccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9840 - RNA, 3222 nt, Artificial Sequence
  derived and/or modified CDS sequence (opt4) from SFTSV(KAGBH4)__KU507562.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9841 - RNA, 3222 nt, Artificial Sequence
  derived and/or modified CDS sequence (opt4) from SFTSV(KAGBH5)__KP663738.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggcccccuguacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggagaccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagaugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccgugggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccuggccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9842 - RNA, 3222 nt, Artificial Sequence
  derived and/or modified CDS sequence (opt4) from SFTSV(KAGBH6)__KP663741.1__GP
augaucaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaucagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucagcgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcaggccuucagaagcagaaccaagcuggccuga

SEQ ID NO: 9843 - RNA, 3222 nt, Artificial Sequence
  derived and/or modified CDS sequence (opt4) from SFTSV(KAGNH)__KU507550.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggcagaagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaucagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaagaucagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaaccagguguucagaagcagaaccaagcuggccuga

SEQ ID NO: 9844 - RNA, 3222 nt, Artificial Sequence
  derived and/or modified CDS sequence (opt4) from SFTSV(KAGNH4)__KU507551.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccggcggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucagagugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcagaaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguuccugcugaucaugagccuguucaagcugggcaccaagcagguguucagaagcagaaccaagcuggccuga

SEQ ID NO: 9845 - RNA, 3222 nt, Artificial Sequence
  derived and/or modified CDS sequence (opt4) from SFTSV(KAGWH2)__KU507564.1__GP
augaugaaggugaucugguucagcagccugaucugccuggugauccagugcggcggcgacaccggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacgugugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9846 - RNA, 3222 nt, Artificial Sequence
  derived and/or modified CDS sequence (opt4) from SFTSV(KAGWH3)__KP663735.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugaucgugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgaggugagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucagacugggcaccaagcagguguucagaagcagaaccaagcuggccuga

SEQ ID NO: 9847 - RNA, 3222 nt, Artificial Sequence
  derived and/or modified CDS sequence (opt4) from SFTSV(KAICH)__KU507565.1__GP
augaugaaggugaucugguucagcagccugaucugccuggugauccagugcggcggcgacaccagccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucagcggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagauggaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccgugaccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagcaaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugguuccugggcgugaucggcgugcugcugggcggccuggcccuguucuuccugaucaugagccuguucaagcugggcaccaagcagguguucagaagcagaagcaagcuggccuga

SEQ ID NO: 9848 - RNA, 3222 nt, Artificial Sequence
  derived and/or modified CDS sequence (opt4) from SFTSV(KAJJH)__KU507566.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagagaaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccacaucgagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcggcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9849 - RNA, 3222 nt, Artificial Sequence
  derived and/or modified CDS sequence (opt4) from SFTSV(KAJNH2)__KU507552.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcuggugcugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaacagagacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagagccaagcuggccuga

SEQ ID NO: 9850 - RNA, 3222 nt, Artificial Sequence
  derived and/or modified CDS sequence (opt4) from SFTSV(ZL13-32)__KU361342.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9851 - RNA, 3222 nt, Artificial Sequence
  derived and/or modified CDS sequence (opt4) from SFTSV(AHL/China/2011)__JQ670930.1__GP
augaugaaggugaucugguucagcagccugaucugccuggugauccagugcagcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagaacaccgagauccaguuccacagcggcagccuggugggcaagaccgccauccacgugaagggcgcccugguggacggcaccgacuucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaccggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcgugaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9852 - RNA, 3222 nt, Artificial Sequence
  derived and/or modified CDS sequence (opt4) from SFTSV(AH-YTY/China/05/2012)__KR017849.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9853 - RNA, 3222 nt, Artificial Sequence
  derived and/or modified CDS sequence (opt4) from SFTSV(AHZ/China/2011)__JQ670931.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcauccugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagaucgccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaaguggaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugagcaugcccagcggcgaggugagaaccuuccaccccaugagcggcauccccacccagguguucaagggcgugagcgugaccuaccugggcagcgacauggaggugagcggccugaccggccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggagagcguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggccugaucggcgugcugcugggcggccuggcccuguucuucaugaucaugagccuguucaagcugggcaccaagcagguguucagaagcagaaccaagcuggccuga

SEQ ID NO: 9854 - RNA, 3222 nt, Artificial Sequence
  derived and/or modified CDS sequence (opt4) from SFTSV(DS02/CHN/2013)__KR698332.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacuggugacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaaccugcagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9855 - RNA, 3222 nt, Artificial Sequence
  derived and/or modified CDS sequence (opt4) from SFTSV(DS03/CHN/2013)__KR698333.1__GP
augaugaaggugaucugguucagcagccugaucuaccuggugauccagugcagcggcgacagcggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagagagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcagaaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacaucagaaucgagauggccagacccagaagagugagacacuggauguacagccccgugauccugaccauccuggccgugggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9856 - RNA, 3222 nt, Artificial Sequence
  derived and/or modified CDS sequence (opt4) from SFTSV(DS04/CHN/2013)__KR698334.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuucagacccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggugaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9857 - RNA, 3222 nt, Artificial Sequence
  derived and/or modified CDS sequence (opt4) from SFTSV(DS05/CHN/2013)__KR698335.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugccacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9858 - RNA, 3222 nt, Artificial Sequence
  derived and/or modified CDS sequence (opt4) from SFTSV(HB154/China/2011)__JQ733560.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugaucaacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucagccugaucauguuccugcugaagcugggcaccaagcagguguucagaagcagaaccaagcuggccuga

SEQ ID NO: 9859 - RNA, 3222 nt, Artificial Sequence
  derived and/or modified CDS sequence (opt4) from SFTSV(HB155/China/2011)__JQ733563.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccagauucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9860 - RNA, 3222 nt, Artificial Sequence
  derived and/or modified CDS sequence (opt4) from SFTSV(HB156/China/2011)__JQ733566.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaauccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9861 - RNA, 3222 nt, Artificial Sequence
  derived and/or modified CDS sequence (opt4) from SFTSV(HB2014-04)__KR080475.1__GP
augaugaaggugaucugguuccccagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccacgugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaagcaagcuggccuga

SEQ ID NO: 9862 - RNA, 3222 nt, Artificial Sequence
  derived and/or modified CDS sequence (opt4) from SFTSV(HNXH)__KT254590.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgcccugaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaccggcgugcugcugggcggccuggcccuguucuuccugaucaugagccuguucaagcugggcaccaagcagaucuucagaagcagaaccaagcuggccuga

SEQ ID NO: 9863 - RNA, 3222 nt, Artificial Sequence
  derived and/or modified CDS sequence (opt4) from SFTSV(JS2012-goat01)__KC473538.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccuggacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9864 - RNA, 3222 nt, Artificial Sequence
  derived and/or modified CDS sequence (opt4) from SFTSV(JS2012-tick01)__KC473541.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9865 - RNA, 3222 nt, Artificial Sequence
  derived and/or modified CDS sequence (opt4) from SFTSV(LN2012-14)__KF887436.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacguguggaucgagauggccagacccagaagagugagauacuggauguacagccccgugauccugaccauccuggccgugggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucagagugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggugggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9866 - RNA, 3222 nt, Artificial Sequence
  derived and/or modified CDS sequence (opt4) from SFTSV(LN2012-34)__KF887437.1__GP
augaugaaggugaucugguucuucagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacgugaaggagugcgugaccaccggcagagcccugcugcccgccgugaaccccggccaggaggccugccugcacuucaccgcccccggcagccccgacagcaagugccugaagaucagagugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcaucaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9867 - RNA, 3222 nt, Artificial Sequence
  derived and/or modified CDS sequence (opt4) from SFTSV(LN2012-41)__KF887438.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacgugaaggagugcgugaccaccggcagagcccugcugcccgccgugaaccccggccaggaggccugccugcacuucaccgcccccggcagccccgacagcaagugccugaagaucagagugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggugaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9868 - RNA, 3222 nt, Artificial Sequence
  derived and/or modified CDS sequence (opt4) from SFTSV(LN2012-58)__KF887440.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgugcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggugaugggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9869 - RNA, 3222 nt, Artificial Sequence
  derived and/or modified CDS sequence (opt4) from SFTSV(NB24/CHN/2013)__KR698337.1__GP
augaugaaggugaucugguucagcagccugaucugccuggugauccagugcagcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcgugaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaacaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccgugggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagaagaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaagcaagcuggccuga

SEQ ID NO: 9870 - RNA, 3222 nt, Artificial Sequence
  derived and/or modified CDS sequence (opt4) from SFTSV(NB31/CHN/2013)__KR698338.1__GP
augaugaaggugaucugguucagcagccugaucugcuucgugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccagcgagaacagcaacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagaacaccgagauccaguuccacagcggcagccuggugggcaagaccgugauccacgugaagggcgcccugguggacggcaccgaguucaccuucgagggcagcugcauguuccccgacggcugcgaggccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaacagagacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagugcugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcguggugggcgugcugcugggcggccuggugcuguucuuccugaucaugagccuguucaagcugggcaccaagcagguguucagaagcagaaccaagcuggccuga

SEQ ID NO: 9871 - RNA, 3222 nt, Artificial Sequence
  derived and/or modified CDS sequence (opt4) from SFTSV(NB38/CHN/2013)__KR698341.1__GP
augaugaaggugaucugguucagcagccugaucugccuggugauccagugcggcggcgacaccagccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacgaggaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucagcggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagauggaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaaccacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagcaaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugguuccugggcgugaucggcgugcugcugggcggccuggcccuguucuuccugaucaugagccuguucaagcugggcaccaagcagguguucagaagcagaagcaagcuggccuga

SEQ ID NO: 9872 - RNA, 3222 nt, Artificial Sequence
  derived and/or modified CDS sequence (opt4) from SFTSV(NB39/CHN/2014)__KR698342.1__GP
augaugaaggugaucugguucagcagccugaucugccuggugauccagugcagcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggcagaagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcgugaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccgugggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgaccugaagugccugaagaucaaggugaagaagaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9873 - RNA, 3222 nt, Artificial Sequence
  derived and/or modified CDS sequence (opt4) from SFTSV(QD7)__KR706566.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccaugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccuuccuggccaucggccuggccgagagcugcgacgagauggugcacgccgacagcaagcuggccagcugcagacagggcagcggcaacaugaaggagugcgugaccaccggcagagcccugcaccccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9874 - RNA, 3222 nt, Artificial Sequence
  derived and/or modified CDS sequence (opt4) from SFTSV(Rodent01/NB/CHN/2014)__KR698343.1__GP
augaugaaggugaucugguucagcagccugaucugccuggugauccagugcagcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggcagaagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcgugaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccgugggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgaccugaagugccugaagaucaaggugaagaagaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaucggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9875 - RNA, 3222 nt, Artificial Sequence
  derived and/or modified CDS sequence (opt4) from SFTSV(SDLZtick12/2010)__JQ684872.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccuuccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9876 - RNA, 3222 nt, Artificial Sequence
  derived and/or modified CDS sequence (opt4) from SFTSV(Zhao)__KF374684.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacuggugacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaaggugagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9877 - RNA, 3222 nt, Artificial Sequence
  derived and/or modified CDS sequence (opt4) from SFTSV(Zhejiang/01/2011)__KJ597824.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacuggugacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9878 - RNA, 3222 nt, Artificial Sequence
  derived and/or modified CDS sequence (opt4) from SFTSV(ZJ2013-06)__KP280204.1__GP
augaugaaggugaucugguucagcagccugaucugccuggugauccagugcagcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcgugaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaacaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccgugggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagaagaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9879 - RNA, 3222 nt, Artificial Sequence
  derived and/or modified CDS sequence (opt4) from SFTSV(ZJZHSH-AM/China/05/2012)__KR017846.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacauccaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9880 - RNA, 3222 nt, Artificial Sequence
  derived and/or modified CDS sequence (opt4) from SFTSV(ZJZHSH-CXD/China/05/2012)__KR017858.1__GP
augaugaaggugaucugguucagcagccugaucugccuggugauccagugcggcggcgacaccggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacgugugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccagaacgacgugagaaucgagauggccagacccagaagagugagacacuggauguacagccccgugauccugaccauccuggccaucggcuucgccgagggcugcgacgagauggugcacgccgacagcaagcuggugagcugcagacagggcagcgagaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9881 - RNA, 3222 nt, Artificial Sequence
  derived and/or modified CDS sequence (opt4) from SFTSV(ZJZHSH-FDE/China/06/2012)__KR017859.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9882 - RNA, 3222 nt, Artificial Sequence
  derived and/or modified CDS sequence (opt4) from SFTSV(ZJZHSH-FZHR/China/07/2013)__KR017862.1__GP
augaugaaggugaucugguucagcagccugaucugccuggugauccagugcggcggcgacaccggccccaucaucugcgccggccccauccacagcaacaagagagccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacgugugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9883 - RNA, 3222 nt, Artificial Sequence
  derived and/or modified CDS sequence (opt4) from SFTSV(ZJZHSH-HCY/China/06/2012)__KR017855.1__GP
augaugaaggugaucugguuccccagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacuggugacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccuguucaugagccuguucaagcugggcaccaagcagguguucagaagcagaaccaagcuggccuga

SEQ ID NO: 9884 - RNA, 3222 nt, Artificial Sequence
  derived and/or modified CDS sequence (opt4) from SFTSV(ZJZHSH-HYC/China/05/2012)__KR017847.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagaaagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9885 - RNA, 3222 nt, Artificial Sequence
  derived and/or modified CDS sequence (opt4) from SFTSV(ZJZHSH-HYJ/China/07/2012)__KR017852.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaaggugaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9886 - RNA, 3222 nt, Artificial Sequence
  derived and/or modified CDS sequence (opt4) from SFTSV(ZJZHSH-LU/China/10/2011)__KR017850.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaugugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacuggugacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9887 - RNA, 3222 nt, Artificial Sequence
  derived and/or modified CDS sequence (opt4) from SFTSV(ZJZHSH-SHZ/China/05/2012)__KR017848.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacuggugacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacggcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9888 - RNA, 3222 nt, Artificial Sequence
  derived and/or modified CDS sequence (opt4) from SFTSV(ZJZHSH-WSH/China/08/2012)__KR017854.1__GP
augaugaaggugaucugguucagcagccugaucugccuggugauccagugcggcggcgacaccggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacgugugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcagaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaagcgugagcugccugaugggcaagcugauggacagaggcagacaggugauccacgaggagaucggcgagaacagagagggcaaccaggacgacgugagaaucgagauggugagacccagaagagugagacacuggauguacagccccgugauccugaccauccuggccaucggccugaccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9889 - RNA, 3222 nt, Artificial Sequence
  derived and/or modified CDS sequence (opt4) from SFTSV(ZJZHSH-XAM/China/06/2012)__KR017853.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacuggugacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9890 - RNA, 3222 nt, Artificial Sequence
  derived and/or modified CDS sequence (opt4) from SFTSV(ZJZHSH-YJX/China/06/2012)__KR017860.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgacgccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccaguuccacagcggcagccuggugggcaagaccaccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcaggccagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcuggacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgaggugaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcugaccggcgccaacauccccagccccaccgacuggcugaacgcccuguucggcaacggccugagcaaguggauccugggcgugaucggcgugcugcugggcggccuggcccuguucuuccugaucaugagccuguucaagcugggcaccaagcagaucuucagaagcagaaccaagcuggccuga

SEQ ID NO: 9891 - RNA, 3222 nt, Artificial Sequence
  derived and/or modified CDS sequence (opt4) from SFTSV(SPL003A)__AB817988.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacagccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccagagugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9892 - RNA, 3222 nt, Artificial Sequence
  derived and/or modified CDS sequence (opt4) from SFTSV(SPL004A)__AB817989.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucagcggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaaggaggacgagaccgccuucagcgugcuggagggcgugcacagcuacaccgugagccugagcuucgaccacgccgugguggacgagcagugccagcugaacugcggcggccacgagagccacgugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaugggcgugcugcugggcggccuggcccuguucuuccugaucaugagccuguucaagcugggcaccaagcagguguucagaagcagaaccaagcuggccuga

SEQ ID NO: 9893 - RNA, 3222 nt, Artificial Sequence
  derived and/or modified CDS sequence (opt4) from SFTSV(SPL005A)__AB817990.1__GP
augaugaaggugaucugguucagcagccugaucugccuggugauccagugcagcggcgacgccagccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagccccuggacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccuggagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcggcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9894 - RNA, 3222 nt, Artificial Sequence
  derived and/or modified CDS sequence (opt4) from SFTSV(SPL010A)__AB817991.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacagccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccaccaucagaggcagcuucagcgugaacuacagaggccugagacugagccugagcgagaucaccgccaccugcaccggcgaggugaccaacgugagcggcugcuacagcugcaugaccggcgccagagugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9895 - RNA, 3222 nt, Artificial Sequence
  derived and/or modified CDS sequence (opt4) from SFTSV(SPL030A)__AB817992.1__GP
augaugaaggugaucugguucagcagccugaucugccuggugauccagugcagcggcgacaccagccccaucaucugcgccggccccauccacagcaacaagagcgccagcaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagccccuggacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcugagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcggcggcaacaugaaggagugcgugaccaccggcagagcccugcugcccgccgugaaccccggccaggaggccugccugcacuucaccgcccccggcagccccgacagcaagugccugaagaucagagugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcaacagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9896 - RNA, 3222 nt, Artificial Sequence
  derived and/or modified CDS sequence (opt4) from SFTSV(SPL053A)__AB985292.1__GP
augaugaaggugaucugguucagcagccugaucugccuggugauccagugcagcggcgacaccggccccaucaucugcgccggccccauccacagcaacaagggcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcaucagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacagccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccagagugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9897 - RNA, 3222 nt, Artificial Sequence
  derived and/or modified CDS sequence (opt4) from SFTSV(SPL054A)__AB985293.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuucauggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacggcgagggcaaccaggacgacgugagaaucgagaucgccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccagauucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9898 - RNA, 3222 nt, Artificial Sequence
  derived and/or modified CDS sequence (opt4) from SFTSV(SPL055A)__AB985294.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacagccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagguggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccagagugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9899 - RNA, 3222 nt, Artificial Sequence
  derived and/or modified CDS sequence (opt4) from SFTSV(SPL057A)__AB985295.1__GP
augaugaaggugaucugguucagcagccugaucugccuggugauccagugcagcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcagaaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcgugaacggcggcgugagacugaucacccugaccagcgagcugaagagcgccaccgugugcgccagccacuucugcagcagcgccaucagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccgugggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagaagaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9900 - RNA, 3222 nt, Artificial Sequence
  derived and/or modified CDS sequence (opt4) from SFTSV(SPL062A)__AB985297.1__GP
augaugaaggugaucugguucagcagccugaucugccuggugaucagaugcagcggcggcaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccagaggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgccauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9901 - RNA, 3222 nt, Artificial Sequence
  derived and/or modified CDS sequence (opt4) from SFTSV(SPL066A)__AB985298.1__GP
augaugaaggugaucugguucagcagccugaucugccuggugauccagugcagcggcgacgccagccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaucagaagcgugagcugccugaugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagaucuucaagggcgugagcgugaccuaccugggcagcgacauggaggugagcggccugaccgaccugugcgagaucgaggagcugagaagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9902 - RNA, 3222 nt, Artificial Sequence
  derived and/or modified CDS sequence (opt4) from SFTSV(SPL070A)__AB985301.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuucauggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagcccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugauggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugaccggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagacccagaaccaagcuggccuga

SEQ ID NO: 9903 - RNA, 3222 nt, Artificial Sequence
  derived and/or modified CDS sequence (opt4) from SFTSV(SPL071A)__AB985302.1__GP
augaugaaggugaucugguucagcagccugaucugccugaucauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggagaccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccuggccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9904 - RNA, 3222 nt, Artificial Sequence
  derived and/or modified CDS sequence (opt4) from SFTSV(SPL077A)__AB985304.1__GP
augaugaaggugaucugguucagcagccugaucugccuggugacccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccauccugaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcagcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcagggcaccaagcagguguucagaagcagaaccaagcuggccuga

SEQ ID NO: 9905 - RNA, 3222 nt, Artificial Sequence
  derived and/or modified CDS sequence (opt4) from SFTSV(SPL084A)__AB985307.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacaccggccugaugcugcugaccaacgugcugaaggccaucggcguguggggcagcugggugaucgcccccgugaagcugauguucgccauccugaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcaggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9906 - RNA, 3222 nt, Artificial Sequence
  derived and/or modified CDS sequence (opt4) from SFTSV(SPL086A)__AB985308.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccagagugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9907 - RNA, 3222 nt, Artificial Sequence
  derived and/or modified CDS sequence (opt4) from SFTSV(SPL087A)__AB985309.1__GP
augaugaaggugaucugguucagcagccugaucugccuggugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaagcgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacacccaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagcccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccugaugggcaagcugauggacagaggcagacaggugauccacgaggagaucggcgagaacagagagggcaacagagacgacaucagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagagaugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9908 - RNA, 3222 nt, Artificial Sequence
  derived and/or modified CDS sequence (opt4) from SFTSV(SPL090A)__AB985311.1__GP
augaugaaggugaucugguuccccagccugaucugccuggugaucagaugcagcggcggcaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccagaggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgccauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9909 - RNA, 3222 nt, Artificial Sequence
  derived and/or modified CDS sequence (opt4) from SFTSV(SPL097A)__AB985312.1__GP
augaugaaggugaucugguucagcagccugaucugccuggugauccagugcagcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaagcagggcaccggccccugccccgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcgugaacggcggcgugagacugaucacccugaccagcgagcugaagagcgccaccgugugcgccagccacuucugcagcagcgccaccagcggcaagaagaacaccgagauccaguuccacagcggcagccuggugggcaagaccgccauccacgugaagggcgcccugcuggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccgugggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagaagaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9910 - RNA, 3222 nt, Artificial Sequence
  derived and/or modified CDS sequence (opt4) from SFTSV(SPL100A)__AB985313.1__GP
augaugaaggugaucugguucagcagccugaucugccuggugauccagugcagcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaagcagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcgugaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugcuggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucgccguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccgugcuggccgugggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagaagaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcaacaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9911 - RNA, 3222 nt, Artificial Sequence
  derived and/or modified CDS sequence (opt4) from SFTSV(SPL106A)__AB985316.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccauccugaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagguggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaucggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucagccugaucaugagccuguucaagcugggcaccaagcaggugcugagaagcagaaccaagcuggccuga

SEQ ID NO: 9912 - RNA, 3222 nt, Artificial Sequence
  derived and/or modified CDS sequence (opt4) from SFTSV(SPL117A)__AB985321.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacagaggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9913 - RNA, 3222 nt, Artificial Sequence
  derived and/or modified CDS sequence (opt4) from SFTSV(SPL120A)__AB985322.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccauccugaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagguggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucagccugaucaugagccuguucaagcugggcaccaagcagguguucagaagcagaaccaagcuggccuga

SEQ ID NO: 9914 - RNA, 3222 nt, Artificial Sequence
  derived and/or modified CDS sequence (opt4) from SFTSV(SPL121A)__AB985323.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagccccaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacagccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaaggugaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagauggaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccagagugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9915 - RNA, 3222 nt, Artificial Sequence
  derived and/or modified CDS sequence (opt4) from SFTSV(SPL124A)__AB985324.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacagccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucagagugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccagagugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaucagccuguucaagcugggcaccaagcagguguucagaagcagaaccaagcuggccuga

SEQ ID NO: 9916 - RNA, 3222 nt, Artificial Sequence
  derived and/or modified CDS sequence (opt4) from SFTSV(SPL128A)__AB985325.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacagccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucagagugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccagagugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgccaucggcgugcugcugggcggccuggcccuguucuuccugaucaucagccuguucaagcugggcaccaagcagguguucagaagcagaaccaagcuggccuga

SEQ ID NO: 9917 - RNA, 3222 nt, Artificial Sequence
  derived and/or modified CDS sequence (opt4) from SFTSV(SPL129A)__AB985326.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucagcggcggcgugagacugaucacccugaccagcgagcugaagagcgccaccgugugcgccagccacuucugcagcagcgccaccagcggcaagaagagcaccgagauccaguuccacagcggcagccuggugggcaaggccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaagcgugagcugccugaugggcaagcugauggacagaggcagacaggugauccacgaggagaucggcgagaacagagagggcaacagagacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggagaccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaaggaggacgagaccgccuucagcgugcuggagggcgugcacagcuacaccgugagccugagcuucgaccacgccgugguggacgagcagugccagcugaacugcggcggccacgagagccacgugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaugggcgugcugcugggcggccuggcccuguucuuccugaucaugagccuguucaagcugggcaccaagcagguguucagaagcagaaccaagcuggccuga

SEQ ID NO: 9918 - RNA, 3222 nt, Artificial Sequence
  derived and/or modified CDS sequence (opt4) from SFTSV(YG1)__AB817987.1__GP
augaugaaggugaucugguucagcagccugaucugccuggugauccagugcagcggcgacaccggccccaucaucugcgccggccccauccacagcaacaagagcgccaacaucccccaccugcugggcuacagcgagaagaucugccagaucgacagacugauccacgugagcagcuggcugagaaaccacagccaguuccagggcuacgugggccagagaggcggcagaagccaggugagcuacuuccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagagcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggagaccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaagcgugagcugccugaugggcaagcugauggacagaggcagacaggugauccacgaggagaucggcgagaacagagagggcaaccaggaggacgugagaaucgagauggccagacccagaagagugagacacuggauguacagccccgugauccuggccauccuggccaucggccuggccgagggcugcgacgagauggugcacgccgacagcaagcuggugagcugcaagcagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccagccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcagcgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9919 - RNA, 3222 nt, Artificial Sequence
  derived and/or modified CDS sequence (opt4) from SFTSV(SDTA_1)__KX641913.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccagagagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcugaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggagaccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagaucgccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9920 - RNA, 3222 nt, Artificial Sequence
  derived and/or modified CDS sequence (opt4) from SFTSV(SDTA_2)__KX641914.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcacaugaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9921 - RNA, 3222 nt, Artificial Sequence
  derived and/or modified CDS sequence (opt4) from SFTSV(SDTA_3)__KX641915.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagguggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9922 - RNA, 3222 nt, Artificial Sequence
  derived and/or modified CDS sequence (opt4) from SFTSV(SDTA_4)__KX641916.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcaucuuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugaucuucgccaucaugaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcggcgcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9923 - RNA, 3222 nt, Artificial Sequence
  derived and/or modified CDS sequence (opt4) from SFTSV(HBGS13_human_2015)__KY440773.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggcaucgccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucaucaucaucaugagccuguucaagcugggcaccaagcagguguucagaagcagaaccaagcuggccuga

SEQ ID NO: 9924 - RNA, 3222 nt, Artificial Sequence
  derived and/or modified CDS sequence (opt4) from SFTSV(HBMC16_human_2015)__KY440776.1__GP
augaugaaggugaucugguucagcagccuggugugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaaggccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9925 - RNA, 3222 nt, Artificial Sequence
  derived and/or modified CDS sequence (opt4) from SFTSV(HBMC5_human_2016)__KY440770.1__GP
augaugaaggugaucugguucagcagccuggugugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaaggugcuguucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaaggccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9926 - RNA, 3222 nt, Artificial Sequence
  derived and/or modified CDS sequence (opt4) from SFTSV(HB29)__KP202164.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccaccugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacaacaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9927 - RNA, 3222 nt, Artificial Sequence
  derived and/or modified CDS sequence (opt4) from SFTSV(HNXY_115)__KC292312.1__GP
augaugaaggugaucugguucagcagccugaucuacuucgugauccagugcagcggcgacagcggcagcaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9928 - RNA, 3222 nt, Artificial Sequence
  derived and/or modified CDS sequence (opt4) from SFTSV(HNXY_144)__KC292307.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9929 - RNA, 3222 nt, Artificial Sequence
  derived and/or modified CDS sequence (opt4) from SFTSV(HNXY_157)__KC292305.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugggugcugggcgugaugggcgugcugcugggcggccuggcccuguucuucaugaucaugagccuguucaagcugggcaccaagcagguguucagaagcagaaccaagcuggccuga

SEQ ID NO: 9930 - RNA, 3222 nt, Artificial Sequence
  derived and/or modified CDS sequence (opt4) from SFTSV(HNXY_170)__KC292304.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccagaucacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugggugcugggcgugaucggcgugcugcugggcggccuggcccuguucuucaugaucaugagccuguucaagcugggcaccaagcagguguucagaagcagaaccaagcuggccuga

SEQ ID NO: 9931 - RNA, 3222 nt, Artificial Sequence
  derived and/or modified CDS sequence (opt4) from SFTSV(HNXY_174)__KC292306.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcagaaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggcaugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9932 - RNA, 3222 nt, Artificial Sequence
  derived and/or modified CDS sequence (opt4) from SFTSV(HNXY_182)__KC292324.1__GP
augaugaaggugaucugguucagcagccugaucugcuucgugauccagugcagcggcgacagcggccccaucaucugcgccggccccauccacagcaacaagagcgccgacaucccccaccugcagggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggccugaucggcgugcugcugggcggccuggcccuguucuucaugaucaugagccuguucaagcugggcaccaagcagguguucagaagcagaaccaagcuggccuga

SEQ ID NO: 9933 - RNA, 3222 nt, Artificial Sequence
  derived and/or modified CDS sequence (opt4) from SFTSV(HNXY_188)__KC292301.1__GP
augaugaaggugaucugguucagcagccugaucugccuggugauccagugcggcggcggcaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9934 - RNA, 3222 nt, Artificial Sequence
  derived and/or modified CDS sequence (opt4) from SFTSV(HNXY_191)__KC292323.1__GP
augaugaaggugaucugguucagcagccugaucugccuggugauccagugcggcggcgacaccggccccaucaucugcgccggccccacccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9935 - RNA, 3222 nt, Artificial Sequence
  derived and/or modified CDS sequence (opt4) from SFTSV(HNXY_195)__KC292326.1__GP
augaugaaggugaucugguucagcagccugaucugcuucgugauccagugcagcggcgacagcggccccaucaucugcgccggccccauccacagcaacaagagcgccgacaucccccaccugcagggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9936 - RNA, 3222 nt, Artificial Sequence
  derived and/or modified CDS sequence (opt4) from SFTSV(HNXY_2)__KC292318.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggcaugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9937 - RNA, 3222 nt, Artificial Sequence
  derived and/or modified CDS sequence (opt4) from SFTSV(HNXY_202)__KC292325.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagaagaucaaccugaagugcaagagaagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9938 - RNA, 3222 nt, Artificial Sequence
  derived and/or modified CDS sequence (opt4) from SFTSV(HNXY_206)__KC292302.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccaccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacaucagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccacccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9939 - RNA, 3222 nt, Artificial Sequence
  derived and/or modified CDS sequence (opt4) from SFTSV(HNXY_207)__KC292315.1__GP
augaugaaggugaucugguuccccagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9940 - RNA, 3222 nt, Artificial Sequence
  derived and/or modified CDS sequence (opt4) from SFTSV(HNXY_224)__KC292317.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucguggugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccugaccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugcgagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccagcccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9941 - RNA, 3222 nt, Artificial Sequence
  derived and/or modified CDS sequence (opt4) from SFTSV(HNXY_231)__KC292313.1__GP
augaugaaggugaucugguucagcagccugaucugcuucgugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9942 - RNA, 3222 nt, Artificial Sequence
  derived and/or modified CDS sequence (opt4) from SFTSV(HNXY_245)__KC292320.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccaucagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9943 - RNA, 3222 nt, Artificial Sequence
  derived and/or modified CDS sequence (opt4) from SFTSV(HNXY_262)__KC292309.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagcagagugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugagaagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9944 - RNA, 3222 nt, Artificial Sequence
  derived and/or modified CDS sequence (opt4) from SFTSV(HNXY_278)__KC292322.1__GP
augaugaaggugaucugguucagcagccugaucugccuggugauccagugcggcggcgacaccggccccaucaucugcgccggccccacccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccggcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagaugauccacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucacccccaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9945 - RNA, 3222 nt, Artificial Sequence
  derived and/or modified CDS sequence (opt4) from SFTSV(HNXY_31)__KC292310.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9946 - RNA, 3222 nt, Artificial Sequence
  derived and/or modified CDS sequence (opt4) from SFTSV/FTLSV(2011YGS5)__KF711925.1__GP
augaugaaggugaucugguucagcagccuggugugccuggugauccagugcagcggcgacagcggccccaucaucugcgccggccccauccacagcaacaagagcgccgccaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccacgacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaaacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacagccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9947 - RNA, 3222 nt, Artificial Sequence
  derived and/or modified CDS sequence (opt4) from SFTSV/FTLSV(2011YGS7)__KF711922.1__GP
augaugaaggugaucugguucagcagccuggugugccuggugauccagugcagcggcgacagcggccccaucaucugcgccggccccauccacagcaacaagagcgccgccaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucuaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccacgacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccagcgugaaccccggccaggaggccugccugcacuucaccgcccccggcagccccgacagcaagugccugaagaucaaggugaagagaaucaaccugaagugcaagaagagcagcagcuacuucgugcccgacgccagaaacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacagccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9948 - RNA, 3222 nt, Artificial Sequence
  derived and/or modified CDS sequence (opt4) from SFTSV/FTLSV(2011YPQ11)__KF711926.1__GP
augaugaaggugaucugguucagcagccuggugugccuggugauccagugcagcggcgacagcggccccaucaucugcgccggccccauccacagcaacaagagcgccgccaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccacgacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccagcgugaaccccggccaggaggccugccugcacuucaccgcccccggcagccccgacagcaagugccugaagaucaaggugaagagaaucaaccugaagugcaagaagagcagcagcuacuucgugcccgacgccagauacagaugcaccagcgugagaagaugccccugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacagccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggcaugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9949 - RNA, 3222 nt, Artificial Sequence
  derived and/or modified CDS sequence (opt4) from SFTSV/FTLSV(2011YPQ12)__KF711930.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccguggccagauacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9950 - RNA, 3222 nt, Artificial Sequence
  derived and/or modified CDS sequence (opt4) from SFTSV/FTLSV(2011YPQ17)__KF711923.1__GP
augaugaaggugaucugguucagcagccuggugugccuggugauccagugcagcggcgacagcggccccaucaucugcgccggccccauccacagcaacaagagcgccgccaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcaacgcccuggacugcaccuucugcagagaguuccugaagaacccccacugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccacgacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccagcgugaaccccggccaggaggccugccugcacuucaccgcccccggcagccccgacagcaagugccugaagaucaaggugaagagaaucaaccugaagugcaagaagagcagcagcuacuucgugcccgacgccagaaacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacagccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9951 - RNA, 3222 nt, Artificial Sequence
  derived and/or modified CDS sequence (opt4) from SFTSV/FTLSV(2011YSC22)__KF711927.1__GP
augaugaaggugaucugguucagcagccuggugugccuggugauccagugcagcggcgacagcggccccaucaucugcgccggccccauccacagcaacaagagcgccgccaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccacgacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccagcgugaaccccggccaggaggccugccugcacuucaccgcccccggcagccccgacagcaagugccugaagaucaaggugaagagaaucaacgugaagugcaagaagagcagcagcuacuucgugcccgacgccagaaacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacagccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccugcugggcaacggcaugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9952 - RNA, 3222 nt, Artificial Sequence
  derived and/or modified CDS sequence (opt4) from SFTSV/FTLSV(2011YSC60)__KF711945.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagaguacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagaaacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugggugcugggcgugaugggcgugcugcugggcggccuggcccuguucuucaugaucaugagccuguucaagcugggcaccaagcagguguucagaagcagaaccaagcuggccuga

SEQ ID NO: 9953 - RNA, 3222 nt, Artificial Sequence
  derived and/or modified CDS sequence (opt4) from SFTSV/FTLSV(2011YSH45)__KF711947.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccuggagugcaagaagagcagcagcuacuucgugcccgacgccagaaacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcagaaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugggugcugggcgugaugggcgugcugcugggcggccuggcccuguucuucaugaucaugagccuguucaagcugggcaccaagcagguguucagaagcagaaccaagcuggccuga

SEQ ID NO: 9954 - RNA, 3222 nt, Artificial Sequence
  derived and/or modified CDS sequence (opt4) from SFTSV/FTLSV(2011YSH52)__KF711928.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggcuucaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaacaagaagugcaagaagagcagcagcuacuucgugcccgacgccagauacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugagcgaccugugcgagaucgaggagcugaacagcaagaagcuggcccuggcccccugcaaccaggccggcaugggcguggugggcaaggugggcgagauccagugcagcagcgaggagagcgccagaaccaucaagaaggacggcugcaucagaaacgccgaccuggugggcaucgaggugagaguggacgacgccguguucuacuucaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugauccugagccuguucaagcugggcaccaagcagaucuucagaagcagaaccaagcuggccuga

SEQ ID NO: 9955 - RNA, 3222 nt, Artificial Sequence
  derived and/or modified CDS sequence (opt4) from SFTSV/FTLSV(2011YXX9)__KF711924.1__GP
augaugaaggugaucugguucagcagccuggugugccuggugauccagugcagcggcgacagcggccccaucaucugcgccggccccauccacagcaacaagagcgccgccaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugggagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccacgacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccagcgugaaccccggccaggaggccugccugcacuucaccgcccccggcagccccgacagcaagugccugaagaucaaggugaagagaaucaaccugaagugcaagaagagcagcagcuacuucgugcccgacgccagaaacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacagccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9956 - RNA, 3222 nt, Artificial Sequence
  derived and/or modified CDS sequence (opt4) from SFTSV/FTLSV(2012YGS10)__KF711937.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccgugcuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9957 - RNA, 3222 nt, Artificial Sequence
  derived and/or modified CDS sequence (opt4) from SFTSV/FTLSV(2012YGS4)__KF711933.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcaucccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9958 - RNA, 3222 nt, Artificial Sequence
  derived and/or modified CDS sequence (opt4) from SFTSV/FTLSV(2012YSC6)__KF711931.1__GP
augaugaaggugaucugguucagcagccugaucugcuucgugauccagugcagcggcggcagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccaucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9959 - RNA, 3222 nt, Artificial Sequence
  derived and/or modified CDS sequence (opt4) from SFTSV/FTLSV(2012YSH10)__KF711940.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaugagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugggugcugggcgugaugggcgugcugcugggcggccuggcccuguucuucaugaucaugagccuguucaagcugggcaccaagcagguguucagaagcagaaccaagcuggccuga

SEQ ID NO: 9960 - RNA, 3222 nt, Artificial Sequence
  derived and/or modified CDS sequence (opt4) from SFTSV/FTLSV(2012YSH104)__KF711943.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagaaaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaccagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagauacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugggugcugggcgugaugggcgugcugcugggcggccuggcccuguucuucaugaucaugagccuguucaagcugggcaccaagcagguguucagaagcagaaccaagcuggccuga

SEQ ID NO: 9961 - RNA, 3222 nt, Artificial Sequence
  derived and/or modified CDS sequence (opt4) from SFTSV/FTLSV(2012YSH105)__KF711944.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcggcgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9962 - RNA, 3222 nt, Artificial Sequence
  derived and/or modified CDS sequence (opt4) from SFTSV/FTLSV(2012YSH107)__KF711942.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccggcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagauacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugggugcugggcgugaugggcgugcugcugggcggccuggcccuguucuucaugaucaugagccuguucaagcugggcaccaagcagguguucagaagcagaaccaagcuggccuga

SEQ ID NO: 9963 - RNA, 3222 nt, Artificial Sequence
  derived and/or modified CDS sequence (opt4) from SFTSV/FTLSV(2012YSH14)__KF711938.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaucggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9964 - RNA, 3222 nt, Artificial Sequence
  derived and/or modified CDS sequence (opt4) from SFTSV/FTLSV(2012YSH16)__KF711934.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagauacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9965 - RNA, 3222 nt, Artificial Sequence
  derived and/or modified CDS sequence (opt4) from SFTSV/FTLSV(2012YSH6)__KF711921.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggaacggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcuggugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9966 - RNA, 3222 nt, Artificial Sequence
  derived and/or modified CDS sequence (opt4) from SFTSV/FTLSV(2012YSH86)__KF711939.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugccacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcaggugcugagaagcagaaccaagcuggccuga

SEQ ID NO: 9967 - RNA, 3222 nt, Artificial Sequence
  derived and/or modified CDS sequence (opt4) from SFTSV/FTLSV(2012YSH89)__KF711935.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgaggccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9968 - RNA, 3222 nt, Artificial Sequence
  derived and/or modified CDS sequence (opt4) from SFTSV/FTLSV(2012YSH9)__KF711919.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagcagagugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacagacccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagaacaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9969 - RNA, 3222 nt, Artificial Sequence
  derived and/or modified CDS sequence (opt4) from SFTSV/FTLSV(2012YSH91)__KF711920.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccacgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgagaaggccagcgagaccaagugcagaugcagccuggugcacaagcccggcgaggugguggugagcuacggcggcaugagagugagacccaagugcuacggcaucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccagcagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaacaucaagugcaagaagagcagcagcuacuucgugagagacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagaagcagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9970 - RNA, 3222 nt, Artificial Sequence
  derived and/or modified CDS sequence (opt4) from SFTSV/FTLSV(2012YSH92)__KF711941.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagccacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugagaaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugggugcugggcgugaugggcgugcugcugggcggccuggcccuguucuucaugaucaugagccuguucaagcugggcaccaagcagguguucagaagcagaaccaagcuggccuga

SEQ ID NO: 9971 - RNA, 3222 nt, Artificial Sequence
  derived and/or modified CDS sequence (opt4) from SFTSV/FTLSV(2012YSH93)__KF711946.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcaacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaccagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagauacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagaugggugcugggcgugaugggcgugcugcugggcggccuggcccuguucuucaugaucaugagccuguucaagcugggcaccaagcagguguucagaagcagaaccaagcuggccuga

SEQ ID NO: 9972 - RNA, 3222 nt, Artificial Sequence
  derived and/or modified CDS sequence (opt4) from SFTSV/FTLSV(YGS1)__KF356537.1__GP
augaugaaggugaucugguucagcagccuggugugccuggugauccagugcagcggcgacagcggccccaucaucugcgccggccccauccacagcaacaagagcgccgccaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccacgacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccagcgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacagccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9973 - RNA, 3222 nt, Artificial Sequence
  derived and/or modified CDS sequence (opt4) from SFTSV/FTLSV(YNY1)__KF356538.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccuguucggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9974 - RNA, 3222 nt, Artificial Sequence
  derived and/or modified CDS sequence (opt4) from SFTSV/FTLSV(YPQ133)__KF356530.1__GP
augaugaaggugaucugguucagcagccugaucugcuucgugauccagugcagcggcgacagcagccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccagaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcgugaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9975 - RNA, 3222 nt, Artificial Sequence
  derived and/or modified CDS sequence (opt4) from SFTSV/FTLSV(YPQ2)__KF356531.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaucgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccauggccagauucagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccaggugaagaucagcggcagcccccuggacaucaccgccaugagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9976 - RNA, 3222 nt, Artificial Sequence
  derived and/or modified CDS sequence (opt4) from SFTSV/FTLSV(YPQ5)__KF356532.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagcagagugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccguggccagauacagaugcaccagcgugagaagaugcagaugggccggcgacugccagagcggcugccccccccacuucaccagcaacagcuucagcaacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcuacauggaggugagcggccugaccgaccugugcgagaucgaggagcugagaagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaugggcgugcugcugggcggccuggcccuguucuucaugaucaugagccuguucaagcugggcaccaagcagguguucagaagcagaaccaagcuggccuga

SEQ ID NO: 9977 - RNA, 3222 nt, Artificial Sequence
  derived and/or modified CDS sequence (opt4) from SFTSV/FTLSV(YSC19)__KF356536.1__GP
augaugaaggugaucugguucagcagccuggugugccuggugauccagugcagcggcgacagcggccccaucaucugcgccggccccauccacagcaacaagagcgccgccaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccaccauggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaugaagaagcugaugagaaccgugagcugccuggugggcaagcugauggacagaggcagacaggugauccacgaggagaucggcgagaacggcgagggcaaccacgacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccagcgugaaccccggccaggaggccugccugcacuucaccgcccccggcagccccgacagcaagugccugaagaucaaggugaagagaaucaaccugaagugcaagaagagcagcagcuacuucgugcccaucgccagaaacagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacagccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccuguucaagcugggcaccaagcagguguucagaagcagaaccaagcuggccuga

SEQ ID NO: 9978 - RNA, 3222 nt, Artificial Sequence
  derived and/or modified CDS sequence (opt4) from SFTSV/FTLSV(YSC3)__KF356535.1__GP
augaugaaggugaucugguucagcagccuggugugccuggugauccagugcagcggcgacagcggccccaucaucugcgccggccccauccacagcaacaagagcgccgccaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagaaucagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagcuacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9979 - RNA, 3222 nt, Artificial Sequence
  derived and/or modified CDS sequence (opt4) from SFTSV/FTLSV(YSH39)__KF356529.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuucauggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggccacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9980 - RNA, 3222 nt, Artificial Sequence
  derived and/or modified CDS sequence (opt4) from SFTSV/FTLSV(YSHX002)__KF356540.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggaacggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcuggugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagaagcagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9981 - RNA, 3222 nt, Artificial Sequence
  derived and/or modified CDS sequence (opt4) from SFTSV/FTLSV(YXX2)__KF356534.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgacuacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9982 - RNA, 3222 nt, Artificial Sequence
  derived and/or modified CDS sequence (opt4) from SFTSV/Huaiyangshan virus(2010-FQM)__HQ419236.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaaggccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccuguucaagcugggcaccaagcagaucuucagaagcagaaccaagcuggccuga

SEQ ID NO: 9983 - RNA, 3222 nt, Artificial Sequence
  derived and/or modified CDS sequence (opt4) from SFTSV/Huaiyangshan virus(2010-LZR)__HQ419237.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccuggauccccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9984 - RNA, 3222 nt, Artificial Sequence
  derived and/or modified CDS sequence (opt4) from SFTSV/Huaiyangshan virus(2010-T112)__HQ419238.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgugcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacgcccccgugauccugaccauccuggccaugggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcguggccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9985 - RNA, 3222 nt, Artificial Sequence
  derived and/or modified CDS sequence (opt4) from SFTSV/Huaiyangshan virus(2010-WJ)__HQ419229.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggcaagagaggcggcagaagccaggugagcuacuaccuggccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucacccccaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9986 - RNA, 3222 nt, Artificial Sequence
  derived and/or modified CDS sequence (opt4) from SFTSV/Huaiyangshan virus(2010-WJQ)__HQ419230.1__GP
augaugaaggugaucugguucagcagccugaucugccuggugauccagugcggcggcgacaccggccccaucaucugcgccggccccacccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcggcugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9987 - RNA, 3222 nt, Artificial Sequence
  derived and/or modified CDS sequence (opt4) from SFTSV/Huaiyangshan virus(2010-WSQ)__HQ419235.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagagagccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccugaucggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgaggacugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagaagagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9988 - RNA, 3222 nt, Artificial Sequence
  derived and/or modified CDS sequence (opt4) from SFTSV/Huaiyangshan virus(2010-WWG)__HQ419231.1__GP
augaugaaggugaucugguucagcacccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuuccccagaaugauggccacccuggaggugaaccagcccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcugcugaucaucaucgugauccugcugggcuacgccggccugaugcugcugaccaacgugcugaaggccaucggcaucuggggcagcugggugaucgcccccgugaagcugaucuucgccaucaucaagaagcugaugagagccgugagcugccugaugggcaagcugauggacagaggcagacaggugauccacgagggcaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9989 - RNA, 3222 nt, Artificial Sequence
  derived and/or modified CDS sequence (opt4) from SFTSV/Huaiyangshan virus(2010-WWX)__HQ419232.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccugcuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugaucgacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9990 - RNA, 3222 nt, Artificial Sequence
  derived and/or modified CDS sequence (opt4) from SFTSV/Huaiyangshan virus(2010-ZGQ)__HQ419233.1__GP
augaugaaggugaucugguucagcagccugaucugccuggugauccagugcggcggcgacaccggccccaucaucugcgccggccccacccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugagccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucguggugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagaucuucagaagcagaaccaagcuggccuga

SEQ ID NO: 9991 - RNA, 3222 nt, Artificial Sequence
  derived and/or modified CDS sequence (opt4) from SFTSV/Huaiyangshan virus(M-HZM)__JF951393.1__GP
augaugaaggugaucugguucagcagccugaccugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagaacaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaaccugagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9992 - RNA, 3222 nt, Artificial Sequence
  derived and/or modified CDS sequence (opt4) from SFTSV/Phlebovirus(AH15/China/2010 strain AH15)__HQ141593.1__GP
augaugaaggugaucugguucuucagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggaugggcgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacgagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaugggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcaucaacuacagaggccugagacugagccugaccgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9993 - RNA, 3222 nt, Artificial Sequence
  derived and/or modified CDS sequence (opt4) from SFTSV/Phlebovirus(HN6/China/2010 strain HN6)__HQ141596.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccuggugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgagaugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaccgugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9994 - RNA, 3222 nt, Artificial Sequence
  derived and/or modified CDS sequence (opt4) from SFTSV/Phlebovirus(JN1/China/2010)__JN258706.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccaacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacuggugacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcugaagggcgugcacagcuacaucgugagccugagcuucgaccacgccgugguggacgagcagugccagcugaacugcggcggccacgagagccaggugacccugaagggcaaccugaucuuccuggacgugcccaucuucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 9995 - RNA, 3222 nt, Artificial Sequence
  derived and/or modified CDS sequence (opt4) from SFTSV/Phlebovirus(JS2010-014)__JQ317170.1__GP
augaugaaggugaucugguucagcuaccugaucugcuucgugauccagugcagcggcgacagcggccccaucaucugggccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagaaucagacccaagugcuacggcuucagcagaaugauggccacccuggaggugagccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagugggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9996 - RNA, 3222 nt, Artificial Sequence
  derived and/or modified CDS sequence (opt4) from SFTSV/Phlebovirus(JS2010-015)__JQ317173.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccuuccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9997 - RNA, 3222 nt, Artificial Sequence
  derived and/or modified CDS sequence (opt4) from SFTSV/Phlebovirus(JS2010-019)__JQ317179.1__GP
augaugaaggugaucugguucagcagccugaccugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagacugggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugagaaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagagcugcgacgagauggugcacgccgacagcaagcuggugagcugcagacagggcagcggcaacaugaaggagugcgugaccaccggcagagcccugcugagcgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcggccacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 9998 - RNA, 3222 nt, Artificial Sequence
  derived and/or modified CDS sequence (opt4) from SFTSV/Phlebovirus(JS24)__HQ830164.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcggcggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagaagaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccacgugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 9999 - RNA, 3222 nt, Artificial Sequence
  derived and/or modified CDS sequence (opt4) from SFTSV/Phlebovirus(JS4/China/2010 strain JS4)__HQ141605.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugcuguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcgagaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 10000 - RNA, 3222 nt, Artificial Sequence
  derived and/or modified CDS sequence (opt4) from SFTSV/Phlebovirus(JS6)__HQ830170.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacgagcccgagcagagaaucggccagugcaccggcugccagcuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaugggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcaucaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccaggugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 10001 - RNA, 3222 nt, Artificial Sequence
  derived and/or modified CDS sequence (opt4) from SFTSV/Phlebovirus(JSD1)__JF267784.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagccacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcaacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugauguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccuuccuggccaucggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 10002 - RNA, 3222 nt, Artificial Sequence
  derived and/or modified CDS sequence (opt4) from SFTSV/Phlebovirus(LN2/China/2010 strain LN2)__HQ141608.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcagaaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgugcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcaucuggggcagcugggugaucgcccccgugaagcugaucuucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacgcccccgugauccugaccauccuggccaugggccuggccgagagcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuucaugaucaugagccuguucaagcugggcaccaagcagguguucagaagcagaaccaagcuggccuga

SEQ ID NO: 10003 - RNA, 3222 nt, Artificial Sequence
  derived and/or modified CDS sequence (opt4) from SFTSV/Phlebovirus(LN3/China/2010 strain LN3)__HQ141611.1__GP
augaugaaggugaucugguucagcagccugaucugccuggugauccagugcggcggcgacaccggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaaccagcccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugguguucgccaucaucaagaagcugaugagagccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaucggccuggccgagggcugcgacgagauggugcacgccgacagcagacuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacagcgugagccugagcuucgaccacgccgugguggacgagcagugccagcugaacugcggcggccacgagagccacgugacccugagaggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 10004 - RNA, 3222 nt, Artificial Sequence
  derived and/or modified CDS sequence (opt4) from SFTSV/Phlebovirus(SD24/China/2010 strain SD24)__HM802201.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacaucgccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucauguuccugcugaagcugggcaccaagcagguguucagaagcagaaccaagcuggccuga

SEQ ID NO: 10005 - RNA, 3222 nt, Artificial Sequence
  derived and/or modified CDS sequence (opt4) from SFTSV/Phlebovirus(SD4/China/2010 strain SD4)__HM802203.1__GP
augaugaaggugaucugguucagcagccugaucugcuucgugauccagugcagcggcgacagcggccccaucaucugcgccggccccauccacagcaacaagagcgccgacaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaagggcagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaagagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaagaccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugaagagcgccaccgugugcgccagccacuucugcagcagcgccaccagcggcaagaagagcaccgagauccaguuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugcuguucgccaucaucaagaagcugaugagaaccgugagcugccugaugggcaagcugauggacagaggcagacaggugauccacgaggagaucggcgagaacagagagggcaaccaggacgacgugagaaucgagauggccagacccagaagagugagacacuggauguacagccccgugauccugaccauccuggccaccggccuggccgagggcugcgacgagauggugcacgccgacagcaagcuggugagcugcagacagggcagcggcaacaugaaggagugcgugaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccaccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcgugaucggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaccgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucaugagccuguucaagcugggcaccaagcagguguucagaagcagaaccaagcuggccuga

SEQ ID NO: 10006 - RNA, 3222 nt, Artificial Sequence
  derived and/or modified CDS sequence (opt4) from SFTSV/Phlebovirus(SDYY104/China/2011)__KU239112.1__GP
augaugaaggugaucugguucagcagccugaucugccuggugauccagugcagcggcgacagcggccccaucaucugcgccggccccauccacagcaacaagagcgccggcaucccccaccugcugggcuacagcgagaagaucugccagaucgacagacugauccacgugagcagcuggcugagaaaccacagccaguuccagggcuacgugggccagagaggcggcagaagccaggugagcuacuaccccgccgagaacagcuacagcagauggagcggccugcugagccccugcgacgccgacuggcugggcaugcugguggugaagaaggccaaggagagcgacaugaucgugcccggccccagcuacaagggcaagguguucuucgagagacccaccuucgacggcuacgugggcuggggcugcggcagcggcaagagcagaaccgagagcggcgagcugugcagcagcgacagcggcaccagcagcggccugcugcccagcgacagagugcuguggaucggcgacguggccugccagcccaugacccccauccccgaggagaccuuccuggagcugaacagcuucagccagagcgaguuccccgacaucugcaagaucgacggcaucguguucaaccagugcgagggcgagagccugccccagcccuucgacguggccuggauggacgugggccacagccacaagaucaucaugagagagcacaagaccaagugggugcaggagagcagcagcaaggacuucgugugcuacaaggagggcaccggccccugcagcgagagcgaggagaaggccugcaagaccagcggcagcugcagaggcgacaugcaguucugcaagguggccggcugcgagcacggcgaggaggccagcgaggccaagugcagaugcagccuggugcacaagcccggcgaggugguggugagcuacggcggcaugagagugagacccaagugcuacggcuucagcagaaugauggccacccuggaggugaacccccccgagcagagaaucggccagugcaccggcugccaccuggagugcaucaacggcggcgugagacugaucacccugaccagcgagcugagaagcgccaccgugugcgccagccacuucugcagcagcgccaccagcggcaagaagagcaccgagauccacuuccacagcggcagccuggugggcaagaccgccauccacgugaagggcgcccugguggacggcaccgaguucaccuucgagggcagcugcauguuccccgacggcugcgacgccguggacugcaccuucugcagagaguuccugaagaacccccagugcuaccccgccaagaaguggcuguucaucaucaucgugauccugcugggcuacgccggccugaugcugcugaccaacgugcugaaggccaucggcguguggggcagcugggugaucgcccccgugaagcugauguucgccaucaucaagaagcugaugagaaccgugagcugccuggugggcaagcugauggacagaggcagacaggugauccacgaggagaucggcgagaacggcgagggcaaccaggacgacgugagaaucgagauggccagacccagaagagugagacacuggauguacagccccgugauccugaccauccuggccaucggccuggccgagggcugcgacgagauggugcacgccgacagcaagcuggugagcugcagacagggcagcggcaacaugaaggagugcaucaccaccggcagagcccugcugcccgccgugaaccccggccaggaggccugccugcacuucaccgcccccggcagccccgacagcaagugccugaagaucaaggugaagagaaucaaccugaagugcaagaagagcagcagcuacuucgugcccgacgccagaagcagaugcaccagcgugagaagaugcagaugggccggcgacugccagagcggcugccccccccacuucaccagcaacagcuucagcgacgacugggccggcaagauggacagagccggccugggcuucagcggcugcagcgacggcugcggcggcgccgccugcggcugcuucaacgccgcccccagcugcaucuucuggagaaaguggguggagaacccccacggcaucaucuggaaggugagccccugcgccgccugggugcccagcgccgugaucgagcugaccaugcccagcggcgaggugagaaccuuccaccccaugagcggcauccccacccagguguucaagggcgugagcgugaccuaccugggcagcgacauggaggugagcggccugaccgaccugugcgagaucgaggagcugaagagcaagaagcuggcccuggcccccugcaaccaggccggcaugggcguggugggcaaggugggcgagauccagugcagcagcgaggagagcgccagaaccaucaagaaggacggcugcaucuggaacgccgaccuggugggcaucgagcugagaguggacgacgccgugugcuacagcaagaucaccagcguggaggccguggccaacuacagcgccauccccaccaccaucggcggccugagauucgagagaagccacgacagccagggcaagaucagcggcagcccccuggacaucaccgccaucagaggcagcuucagcgugaacuacagaggccugagacugagccugagcgagaucaccgccaccugcaccggcgaggugaccaacgugagcggcugcuacagcugcaugaccggcgccaaggugagcaucaagcugcacagcagcaagaacagcaccgcccacgugagaugcaagggcgacgagaccgccuucagcgugcuggagggcgugcacagcuacaucgugagccugagcuucgaccacgccgugguggacgagcagugccagcugaacugcggcggccacgagagccaggugacccugaagggcaaccugaucuuccuggacgugcccaaguucguggacggcagcuacaugcagaccuaccacagcaccgugcccaccggcgccaacauccccagccccaccgacuggcugaacgcccuguucggcaacggccugagcagauggauccugggcgugaucggcgugcugcugggcggccuggcccuguucuuccugaucguguuccugcugaagcugggcaccaagcaggccuucagaagcagaaccaagcuggccuga

SEQ ID NO: 10007 - RNA, 3417 nt, Artificial Sequence
  derived and/or modified CDS sequence (opt3) from ANDV(Chile-9717869)__AF291703.2__GP
auggagggcugguaccuggugguccucgggguuugcuauacccuuacacuggccaugcccaagacuaucuacgaauugaaaauggaguguccucacacggugggauuaggucagggcuauauuauagggagcaccgaacugggacuaaucuccauugaggcugcaucugacaucaagcucgaaucaaguugcaacuucgaucugcauacaacuagcauggcccaaaaauccuuuacccagguagaguggagaaagaaaucugacacaaccgauacuacaaaugcggcuucgaccacguucgaggcccagacuaagaccgugaaccuuaggggcacauguauucuggcaccagaauuguacgacacucucaagaaagucaagaaaaccgugcugugcuaugaucugacauguaaucagacccacugccaaccgacgguuuaccucaucgcccccguguuaacuuguaugucaauacggagcugcauggcuagugucuuuacaucccgcauccaggugauuuaugagaagacccauuguguaacuggucagcugaucgaagggcagugcuucaacccugcacacacacuuaccuugucucaaccagcccauacguacgacaccguuacacugcccauuagcuguuucuucacuccuaaaaaguccgagcagcuaaaggugaucaaaaccuuugagggaauacucacaaagacuggcugcaccgaaaaugcucugcagggcuacuaugucugcuuccuugggucacacagugagccacugauugugcccagcuuggaagauauccgaucugccgagguggucucccguaugcucguucacccuagaggagaagaccaugaugcgauucagaacucacaaagccaccugaggaucguggguccaaucacagcaaaaguaccgaguaccucuuccacugacacguuaaagggcacagccuuugcuggggugcccauguacagcucgcugucuacccucguccggaaugccgauccugaguucguguuuuccccaggaauuguucccgagucaaaccauaguacuugugacaaaaagaccgugccuauaacauggaccggcuaucuuccaaucagcggugaaauggagaaagucacugggugcacaguguucuguacgcuggcaggacccggcgcuuccugcgaagccuacucugagaauggcauuuuuaacaucagcucaccgaccuguuugguaaauaagguucagcgcuucagagggagugaacagaagauaaacuucauuugccaaaggguggaucaggacgucguggucuauuguaauggacagaaaaaggugauccuaacuaaaacacugguuaucggucagugcauuuacaccuuuacaucccucuucagccugaugccugacguggcgcacucucuugccguagagcuguguguccccggcuugcacgggugggcaacugugaugcuccugucaaccuuuugcuucggauggguuuuaaucccagcugugacgcugauuauacuaaagugucuccggguccugaccuuuaguugcagccauuauacaaacgaguccaaauucaaguuuauccuugaaaaggugaaaauugaguaccaaaagacuaugggcucuaugguaugcgaugugugucaccaugaaugcgagaccgccaaagaauuggagucgcaccgccagagcuguaucaauggucagugcccuuacuguaugacaaucacugaggcuaccgaauccgcccugcaggcacauuauucaauuugcaagcucacggggcgauuccaagaggcccugaaaaagagucuuaagaaacccgaaguuaagaaaggcuguuacagaacacugggagucuuuagguauaagucucggugcuacgugggcuugguguggugucuccuguuaaccugcgagauagucaucugggcugcgagcgcagagacuccacugauggaauccggguggucagacacagcccacggaguuggugagauucccaugaaaaccgaucuagaacucgacuucagccugccuucuuccaguagcuauucuuaccgucgcaagcucacuaacccagcuaacaaggaggaauccaucccguuucacuuccagauggagaaacaggugauucaugccgagauccagcccuugggccacuggauggaugcaaccuuuaauauaaagacagccuuccauuguuauggggcuugccaaaaauacucauacccuuggcagacgaguaagugcuucuuugaaaaagacuaucaguacgagaccggauggggcuguaacccaggugauugccccggggugggcacuggauguacagccugcggcguauaucuggacaagcucaaaagcgucgggaaggcauacaagaucauuucgcugaaauauaccagaaagguguguauccaguuaggaacagaacaaacuugcaaacacauugaugcgaaugacugucugguuaccccuuccgugaaggucugcaucguggguacgguuucuaaacuucagccaagcgauacauugcucuuucugggcccccuagagcaagggggaauaauucugaagcagugguguaccacuucaugcgcuuuuggcgacccgggugacaucaugaguaccccuuccgggaugagguguccagaacacacaggcucuuuccggaagauuugcggauuugccacuacccccgugugcgaguaccagggcaacacaaucagcggguauaaacgaaugauggcaacgaaggauuccuuccagucauuuaaucucaccgagccucauauaacuacaaacaaacuggaauggaucgaccccgauggaaauacccgcgaccacguaaaccuugucuugaauagagaugugagcuuccaggaccugagugauaacccauguaagguggacuuacauacucaagccauugagggcgcuugggguucuggggucggauuuacacuuaccugcacgguuggccugacugaauguccuuccuucaugaccagcaucaaagccugcgaucuugcaauguguuacgguucgacagugaccaaucuggcuaggggcucaaacacuguaaagguggucgggaagggaggccacucugggaguuccuuuaaaugcugucaugacacagauugcagcucugagggauugcucgccagcgcgccccaccuggaacgggugaccggcuucaaucagauugacuccgauaagguuuacgacgacggugccccaccguguacauuuaaaugcugguucacuaagucaggggaguggcuacugggaauccucaacggcaauuggauaguggucgugguucugguggucauucuuaucuugaguaucauuauguucagcguacuguguccucgcagaggucacaaaaagaccguguga

SEQ ID NO: 10008 - RNA, 3417 nt, Artificial Sequence
  derived and/or modified CDS sequence (opt3) from ANDV(AH-1)__AF324901.2__GP
auggagggcugguaccugguggcccucggggucugcuauacccuuacacuggcuaugcccaagacuaucuacgaauugaaaauggaguguccucacacgguuggauuaggucagggcuauauuauagggagcaccgaacugggacuaaucuccauugaggcagccucugacaucaagcucgaaucaaguugcaacuucgaucugcauacaacuagcauggcgcaaaaauccuuuacccagguggaguggagaaagaaaucugacacaaccgauacuacaaaugcugccucgaccacguucgaggcacagacuaagaccguaaaccuuaggggcacauguauucuggccccagaauuguacgacacucucaagaaagugaagaaaaccguccugugcuaugaucugacauguaaucagacccacugccaaccgacgguguaccucaucgcucccguuuuaacuuguaugucaauacggagcugcauggcaaguguguuuacaucccgcauccaggucauuuaugagaagacccauugugugacuggucagcugaucgaagggcagugcuucaacccugcccacacacuuaccuugucucaaccagcucauacguacgacaccguaacacugcccauuagcugcuuuuucacuccuaaaaaguccgagcagcuaaagguuaucaaaaccuuugagggaauacucacaaagacuggcuguaccgaaaaugcccugcagggcuacuaugugugcuuccuugggucacacagugagccacugauuguccccagcuuggaagauauccgaucugcggagguggugucccguaugcucguccacccuauuggagaagaccaugaugcaauccagaacucacaaagcuaccugagaaucguugguccaauuacagccaaagugccgaguaccucuuccacugacacguuaaagggcauagcuuuugccgggguacccauguauagcucguucucuacacuggugaggaaugcagauccugaguuugucuucuccccaggaaucauucccgagucaaaccacagugugugugacaaaaagaccguuccuaucacuuggaccggcuaccucccaauaagcggugaaauggagaaagugacagggugcaccgucuuuuguacucuugcuggacccggcgccuccugcgaagcguauucugagaauggcauuuucaacaucagcucaccgacaugucuggugaauaagguacagcgguuccgcgggagugaacagaagaucaacuuuauuugccaaagaguugaucaggacguggucguguacuguaauggacagaaaaaggucaucuugacgaaaacccuagugauuggucagugcauauauacuuucacaucccuguuuagccucaugccugacguugcccauucucuggcaguggagcuuuguguacccggccugcacgggugggcuaccgucauguugcucucaacauucugcuuuggaugggugcugaucccagccguuacuuuaauuauccugaagugucuaagggugcucaccuucaguugcagccacuacacgaacgaguccaaauuuaaguucauccuggaaaaggucaaaguggaguaccaaaagaccaugggcucuaugguaugcgaugugugucaucacgaaugcgagacagcuaaagaacuugagucgcaucggcagagcuguauuaauggucagugcccuuauuguaugacuauaaccgaggccacagaauccgcauugcaggcccacuacucaaucugcaagcugacugggcgcuuucaagaggcucucaaaaagagucugaagaaacccgaaguuaagaaaggcuguuaucgaacccuuggagucuucagauacaagucuaggugcuaugugggccuggugugguguuugcuccugacgugcgagauugucaucugggcggcaagcgccgagacaccauuaauggaauccggguggucagacaccgcucauggaguuggugagauucccaugaaaacugaucuggaacuagacuuuagccucccuucuuccaguagcuacucuuaucggcguaagcugacaaacccagccaacaaggaggaauccaucccguuccacuuucagauggagaaacaggugauacacgcagagauccagccccuuggccauuggauggaugccaccuucaauauuaagacugcuuuccacuguuacggggccugccaaaaauacucauauccuuggcagaccaguaagugcuuuuucgaaaaagacuaccaguaugagacaggauggggcuguaacccaggugauugccccggggugggcacgggauguaccgcaugcggcguauacuuggacaagcugaaaagcgucgggaaggcguauaagaucauuucgcucaaauacacucgcaagguguguauccagcugggaacagaacaaaccugcaaacauauagaugcuaaugacuguuuaguuacaccuuccgugaaggucugcauuguggguacuguuucuaaacugcagccaagcgauacccuuuuguuucucggcccccuggagcaagggggaaucauucuaaagcagugguguacgacaucaugcgccuucggcgacccgggugacaucaugaguaccccuuccgggaugagauguccagaacacacuggcucuuuuaggaagauaugcggauucgcaaccacacccgugugcgaguaucagggcaacacuguaagcggguacaaacggaugauggccaccaaggauuccuuucagucauucaaucugacagagccucacaucacgaccaacaaacucgaauggauugaccccgauggaaauacucgagaccaugucaaccuggugcuuaaucgcgaugugagcuuucaggacuugagugauaacccauguaaggucgaccugcacacacaagcuaucgagggcgccugggguucugggguuggauucaccuuaacuugcacagugggccucaccgaauguccuuccuuuaugacgagcauuaaagcaugcgaucuggcuauguguuacgguucgacuguagccaaucuugcgagaggcucaaacaccgugaaggucguggggaagggaggccauucugggaguuccuucaaaugcugucacgacacagauugcagcucugagggacuguuggccagcgcuccccaucucgaaaggguuaccggcuuuaaucagaucgacuccgauaagguguaugacgacggugcaccaccguguacuuucaaaugcugguucacaaagucaggggaguggcugcuaggaauacugaacggcaauuggauugucgugguugugcucgucguaauccugauccuuaguauuaucauguuuagcguguuguguccucggcgcggucacaaaaagaccguuuga

SEQ ID NO: 10009 - RNA, 3417 nt, Artificial Sequence
  derived and/or modified CDS sequence (opt3) from ANDV(CHI-7913)__AY228238.1__GP
auggagggcugguaccugguggcccucgggaucugcuauacccuuacacuggccaugcccaagacuacguacgaauugaaaauggaguguccucacaccgucggauuaggucagggcuauauuauagggagcacagaacugggacuaaucuccauugaggcagccucugacaucaagcucgaaucaaguugcaacuucgaucugcauacuaccagcauggcgcaaaaauccuuuacacagguugaguggagaaagaaaucugacaccacugauacaaccaaugcugccucgacgacuuucgaggcacagaccaagacagugaaccuuaggggcacuuguauucuggccccagaauuguacgacacccucaagaaaguaaagaaaacagugcugugcuaugaucugaccuguaaucagacgcacugccaaccgacugucuaccucaucgcucccguguuaacauguaugucaauacggagcugcauggcacgcguuuuuaccagucgaauccaggugauuuaugagaagacucauugugucacaggucagcugaucgaagggcagugcuucaacccugcccacacccuuacguugucccaaccagcucauaccuacgacacagugacucugcccauuucuugcuuuuucaccccuaaagagagcgagcagcuaaagguaaucaagacauuugaaggaauacucacuaaaaccggcuguacagagaaugcccugcagggcuacuauguuugcuuccuugggucccacucagaaccacugauugugcccaguuuggaggauauccguagcgcggaagucgugucuagaaugcucgugcacccuaggggagaggaccaugaugcaauucagaacucccaaucacaucugcggaucgucgguccaaucaccgccaagguuccgagcacuagcucuacggacacauuaaaaggcaccgcuuuugccggggugcccauguacuccagccugucgacucucguaaagaaugcagauccugaguucguguuuucuccaggaauuauacccgaauccaaccacucagucugugacaaaaagaccgugccuaucacauggaccggcuaucuuccaauuaguggugagauggaaaaaguuacugggugcacaguguucuguacgcuggcuggacccggcgccagcugcgaggcguacuccgaaaauggcaucuuuaacauaucuagcccgaccuguuuggucaauaaggugcagcgcuucagagggucagagcagaagauuaacuucaucugccaaaggguagaucaggacguuguggucuauuguaauggacagaaaaaggugauccuaacuaaaacacuggucauuggucagugcaucuacaccuuuacaagucucuucucccugaugccugacguggcccacagccuugcaguugagcugugugugcccggcuugcacgggugggcuacuguaaugcuccugucuaccuuuugcuucggaugggucuuaauuccagccgugacgcugauaauccuaaagugucuccggguucugaccuuuucaugcagucauuauacaaacgaaagcaaauucaaguuuauucuugagaaggugaaagucgaauaccaaaagacuaugggcuccauggugugcgauguaugucaccaugagugcgaaaccgcuaaagaguuggagucucaccgccagucguguaucaauggucagugcccuuacuguaugacaaucacugaagccaccgagagcgcacugcaggcccauuauuccauuugcaagcucacggggcgauuccaagaagcucugaaaaagucacuuaagaaacccgaggugaagaaaggcuguuacagaacacugggaguuuuuagguauaagagucggugcuacgucggcuugguguggugucuccuguuaaccugcgagauagugaucugggcggcaucugccgaaacuccacugauggagagcgggugguccgacacagcucacggagucggugaaauucccaugaaaaccgaucuagagcucgacuucucacugccuaguucuuccaguuauagcuaccgucgcaaacuuacuaacccagccaacaaggaagagucuaucuccuuucacuuccagauggagaaacagguuauucaugcagaaauccagccguugggccacuggauggaugccaccuuuaauacaaagacggcuuuccauuguuauggggccugccaaaaauacucauaccccuggcagaccaguaagugcuucuuugagaaagacuaucaguacgaaacuggauggggcuguaacccuggugauugcccaggggugggcacaggauguaccgcaugcggcguguaucuggacaagcucaaaagcguagggaaggcguacaagauaaucucgcugaaauauacaagaaaggucuguauucaguuaggaacugagcaaaccugcaaacacaucgaugcuaaugacugucuggugacgcccuccguuaaggugugcauugucgguacagugucuaaacuucagccuagcgauacccuccucuuccugggcccacuagaacaagggggaguuauccugaagcagugguguacuaccucaugcgccuuuggcgaccccggugacauaaugaguacaccguccgggaugagguguccugagcacacuggcucuuuccggaagauuugcggauuugcaaccacaccagugugcgaguaccagggcaacacgaucagcggguauaaacgaaugauggccaccaaggauuccuuccagucauuuaaucucacugaaccccauauuacagcuaacaaacuggaguggaucgacccugauggaaauacccgcgaccacguaaaccuugucuugaauagagaugugagcuuccaggaccugagugauaaccccuguaagguggacuuacauacucaagccauagaaggcgcaugggguucuggggucggauuuacauugaccugcacgguuggccugacugaguguccauccuucaugaccagcaucaaggcuugcgaucuugccauguguuacgguucgacaguggcgaaucuggccaggggcucaaacaccguaaagguggucgggaagggaggccacucugggaguuccuuuaaaugcugucaugacacugauugcagcucugaaggauugcucgcuagcgcaccucaccuggagcgggugacaggcuucaaucagauugacuccgauaagguuuacgacgacggugcucccccauguaccuuuaaaugcugguucacaaagucaggggaguggcuacugggaauccucaacggcaauuggauuguggucgugguucugguggucauccuuauauugaguauuaucauguucagcguacuguguccgcgcagaggucacaaaaagacuguguga

SEQ ID NO: 10010 - RNA, 3417 nt, Artificial Sequence
  derived and/or modified CDS sequence (opt3) from Hu39694(Hu39694)__AF028023.1__GP
auggagggcugguaccugaucgugcucggggucugcagcacccuuacacuggccaugcccagaacuauuuaugaauugaggauggaguguccucacacgguuggauuaggucagggcuacauaaucggguccaccgaacugggacuaauuccaaucgagacagugucugaccucaagcuggaaucaaguugcaacuucgaucuucauacuaccagcaugacacaaaaauccuauacccagguagaguggcggaagaaaucugacacuacagauaccacgaaugcugcaucgacuaccuuugaggcccagacaaagacugugaaccugcgcggcaccugugucuuggcgucagaacucuacgacacacugaaaaagauuaagaaaaccgugcugugcuaugaucucacguguaaucagacucacugccaaccgacaguuuacuuaaucgcucccgugagcaccuguaugaguauacgauccugcauggccucugucuucacuaaccguauccaggugauuuaugagaagacacauuguguaaccggucagcugguugaagggcagugcuuuaauccugcacacacgcuuaccuugagccaaccagcccauacauacgagauggugacucugcccgucaccuguuucuuuacaccuaaaaaguccgaccagcuaaaacucaucaagacuuucgagggaauuaucucaaagaccggcugcacagaaaacgcucugcagggcuacuaugugugcuuucuugggagucacagcgagccacugcacgugcccucuuuggaagauauaagauccgucgagguuuucucaaggaugauuauccauccucggggagaagaccacgauccaauucagaauagccaagguuuucuccgcaucgugggcccgaucaccgcaaaaguacccaguacuucuuccacggacacacugaaggggaccgccuucgcuggagugccuauguacagcucguuaucuacucuggucagaaccacagauccagaguauguguuuucccccggcauuauaccugagucaaaccauaguaccugugacaaaaagacuaucccacucacauggacggguuaccuucccauugccggggaaauggagaaaguuaccggaugcacuguguucuguacacuggcgggcccgggcgcaagcugcgaagccuauuccgagcacgggaucuuuaauauaucuagcccuaccuguuugguccacaaggugcagaaauucaggggaucagaacagaagauuaacuucaucugccaacggguagaucaggacguuguggucuacuguaauggucagaagaaagugauccuaacaaaggaccuggucauuggccagugcaucuauacuuuuaccagucucuucucccugaugcccgauguggcucauagccuugccguugagcugugugugccaggguugcacggaugggcaacgguaaugcuccugucuaccuuuugcuucggcuggauuuuaauaccugcuaucacacuggucgugcuaaaauuucucaagauggccacuuucucauguagucauuacaccaacgagagcaaauuuaaguucauucuggaaaagguuaaaguggaguaccaaaagacaauggguuccauggucugcgacaucugccaccaugaaugugagacugcgaaagaacuugagucucacaagcagucgugcaucaaugggcagugucccuauugcaugaccaugacggaggccacagaaagcgcauugcaggcucacuacuccauuuguaaacugaccggccgcuuucaagaggcccucaagaagucacugaaacgaccagaagugaagaaaggaugcuauagaacucuuggcguauucagguacaagagucgguguuauguggggcugguuuggugcgucuugcucacaugugagcugauagugugggcugccucugcagagacccccuuacuggaaagcggaugguccgauacugcccauggugugggcgaggucccuaugaaaaccgaccuagaacucgauuuuucacugccaucuagcuccaguuacagcuaucgucgcaaguugacaaacccggcuaauaaggaggaaucuauccccuuccacuuucagauggagaaacagguuauucaugcggagauccagacguuggggcacuggauggacgcaaccuucaacauuaagacugccuuccacugcuacggagcuugucaaaaauacuccuauccuuggcagacagccaagugcuuuuucgaaaaagauuaccaguaugagaccggcugggguugcaacccaggggacugucccggcuuuggaacaggcugcacugcaugugggguguaccuggauaagcucaaaucagugggaaaggccuauaagaucauaagucugaaauacaccagaaagguaugcauccaguuagguacggaacaaacauguaaacauauugacgcuaaugauugccuggucaccccuagcgugaagguuuguaucauuggcacugugucgaaacuucagccauccgacacccuucucuuccuggggccccuagagcagggaggcauccugcucaagcaauggugcacaacuucuugugccuuuggugacccgggggauauaaugagcaccacaucaggcaugaggugcccugaacacacgggaaguuuccggaagauuuguggcuuugcaaccacuccagucugcgaguaucaggggaacacaaucuccggauacaaacgaaugauggcgaccaaggacucuuuccagagcuuuaaucugacugauccccauauuacaaccaacaaacuugaguggaucgacccugauggcaauacgcgcgaccacgugaacuugguucugaauagagauguguccuuccaggacuuaucagauaaccccugcaagguagaccuccauacucaagcuauagaaggugccugggggagcggagucggcuuuacccugacauguaccgugggucuuacugagugcccaaguuucaucacaucuauuaaagcaugugauauggccaugugcuacggcuccaccgugagcaaucuggcuagggggucgaacacagucaagguugugggaaagggcgggcacucaggauugcacucucgguguugccaugacacugauuguaguuccgaaggccucguagccagcgcaccucaccuggagcgcgugaccgguuuuaaucagaucgacucugacaaagucuaugaugacggggcucccccaugcacguucaaguguugguucacaaaaagcggagaauggcuacugggcauucucaacgguaauuggaucgugguugugguccuggugguugugcuuauauuuuccauuaucuuguucaacauccugugcccgagaaggggccauaagaaaaccgucuga

SEQ ID NO: 10011 - RNA, 3417 nt, Artificial Sequence
  derived and/or modified CDS sequence (opt3) from LECV(Of22819)__AF028022.1__GP
auggagggcugguaccugaucgugcucggggucugcagcacccuuacacuggccaugcccaagacuauuuaugaauugaaaauggaguguccucacacgguuggauuaggucagggcauaaucgugggguccaccgaacugggacuaauuccaaucgagacagcuucugaccucaagcuggaaucaaguugcaacuucgaucuucauacuaccagcaugacacaaaaauccuacacccagguagaguggagaaagaaaucugacacuacagauaccacgaaugcagccgcgacuaccuuugagucgcaggcuaagacagugaaccugaggggcacuugugucuuggccgcagaacucuaugacacccugaagaaagugaagaaaacaguucugugcuacgaucucaccuguaaucagacgcacugccaaccgacuguguauuuaauugcccccgucaucacauguaugucaauacggagcugcauggcuaguguguucaucucccgcauucagaucauuuacgagaagacccauuguguaacuggucagcugaucgaagggcagugcuuuaacccugcacacacacuuaccuuggcccaaccagcucauacguaugagaccguuacacugcccgugacuuguuucuuuaccccuaaaaagucugaccagcuaaagcucauaaaaacauucgagggaauuaucagcaagacuggcugcaccgaaaaugcccugcagggcuacuacgucugcuuucuugggucccacucagagccacugcacgugcccaguuugaaagauauucgaagcgcggaaguggucacacguaugaucguucauccuagaggagaggaccacgauccaauccagaacucucaagguuaucucaggauugugggcccgcugaccgcaaagguacccuccacuucaagcagugacacguuacaggggacagccuucgcuggagugccuauguacucuucccugagcacccucguccggaauacugauccagaauuuguguucucgcccggcauaaucccugagucuaaccauuccgccugugacaaaaagaccauuccacuuacauggaccgguuaucugcccaucucaggggagauggaaaaaguuacuggaugcacaguguuuuguacguuggcaggcccgggcgcuaguugcgaggccuacagcgaauccgggauauucaauauuucuagcccuaccugucuagucaacaaggugcagaaguuucgcggaucagagcagaaaaucaauuucaucugccaaagaguagaucaggacguuguggucuauuguaacggucagaagaaagugauucugacuaagacacucgucaucggccaaugcauuuacaccuucacaagucuguuuucccuuaugcccgacguggcgcacagccuggccguugaauugugugugccagggcuccacggaugggcaacuguaaugcuguuaucuaccuucugcuuuggcuggauacugaucccugcuauuacgcuagucgugcucaaaguucugaagguggccaccuucucauguagucauuauacaaaugagagcaaguuuaaauucauccuugagaaggucaaaguggaauaccagaagacuauggguuccaugguaugcgauaucugccaccaugagugugaaaccgcuaaagaguuggaaucucacaagcagucgugcauuaacgggcagugucccuacugcaugacaaugacugaggccaccgagagcgcacugcaagcccauuuugcuauauguaagcucacgggcagguuccaggaagcgcugaaaaagucccuuaaaaagccagaggugcggaaaggaugcuaucgcacacugggcguuuuucgauacaagucaagauguuaugucggguugguguggugcgugcuccugaccugugaauuaaucgucugggcagccagugcugagacuccccugcuagagucuggauggagcgacacagcccacgguguuggcgaagugccuaugaagaccgaucucgagcuggacuucucccuuccaucaucuagcuccuacaguuauaggcggaaauugacuaauccggcaaacaaggaagagagcauucccuuucacuuccagauggaaaaacaggugauccaugccgagauucaaaaccuggggcacuggauggaugcuaccuuuaauaucaagacagccuuccauugcuacggagcaugucagaaauauucuuacccuuggcagacggcgaagugcuucuuugagaaagacuaccaguaugaaaccggcugggguugcaacccaggggauugucccggcguaggaacuggcugcacagcuuguggggucuaccucgacaagcugaaguccgugggaaaagccuauaagauaaucucauuaaaauacacccguaagguuugcauucaacuggguacagagcagacuuguaaacacaucgaugcaaaugacugccuugugaccccuagugucaagguguguauuguuggcacggugagcaaguugcagccaucggauacacuccuguuccuagggccccuggaacaaggaggcaucauacucaaacaguggugcaccacuuccugugccuuuggugacccgggggacauuaugucuaccacaagcggcaugcgcugcccugagcacacuggaucauucagaaagaucuguggcuuugcuaccacaccaguaugcgaauaucaggggaacacgauuaguggauacaaaaggaugauggccaccaaggauuccuuccagucuuuuaaucugacugacccccauaucacaaccaacaaacuugaguggauagauccugacggcaauacucgggaucacgucaacuuggugcugaaucgagacgugagcuuccaagauuuauccgacaaccccugcaaggucgaucuccauacacaggcaaucgagggugcuugggggucaggaguuggcuuuacccugacguguacugugggucuuaccgaaugccccagcuucaugacaaguauuaaggccugugaccuggcgaugugcuauggcucuaccguacacaauuuggcccgcggguccaacacugugaaagucgugggaaagggcgggcauagcggaucgucauuuaaauguugccacgauacagacuguucuagugagggccucguugcuuccgcaccucaccuggaaagagugaccgguuucaaucagaucgauagcgacaaggucuacgacgauggggccccaccaugcacauuuaaauguugguucacuaagucuggagaguggcuacugggcauucucaacgguaauuggaucgugguugugguccugguagugguucuuauauucagcauuaucuuguuuuccauccugugcccgaggcggggccauaagaaaaccguguga

SEQ ID NO: 10012 - RNA, 3417 nt, Artificial Sequence
  derived and/or modified CDS sequence (opt3) from ORNV(Ol22996)__AF028024.1__GP
auggagggcugguaccugaucgugcucggggucugcagcaccguuacacuugccaugcccaagacuauuuaugaacugaaaauggaguguccucacacggugggauugggucagggcuacauaaucggguccaccgaauuaaaccugauuccaaucggagcugcaucugaccuaaagcucgagucaaguugcgauuucgaccuguauacaacuccgaugacccagaaaagcuacacacagguagaauggagaaagaaauccgagaccacugauacaaccaaugccgcggcuacgacuuuugagucucagaccaagacagugaaccuuaggggcacuuguauucuggccucggaauuguaugacacccucaauaagaucaaaaagcccguccugugcuacgaucugaacuguaaucagacacggugccaaccuaccguguaucucauagcaccaguuaucacguguaugucaauucgcagcugcauggccaguguguccaacucucgaauccagauuaucuacgagaaaacucauugugucacaggucaguuaguggaagggcagugcuucaaucccagccacacccugacucuugcucaaccugcacauacauacgagaccguaacguugccaguuaccugcuuuuucacacccaagaaauccgaccagcugaagcuagugaagacuuuugagggaauaauuaccaaaacaggcuguacugaaaacgcccuccagggcuauuacgucugcuuccuggggucacacagugagccucuucaugugccaagccuggaagauauccguucugcugagguggucuccagaaugauuguucacccgaggggagaagaccacgaucccauccaaaauucacaaggucauuugcggaucgugggcccuauuaccgccaagguaccaagcacaaguucuuccgacacccuccaggggacugcguuuagcggagugcccauguauucgucucuguccacguuaguccgcucagcagauccugaguucguguuuaguccaggcauacugcccgagagcaaccacuccguuugugacaaaaagacacucccgcuuaccuggacugguuaccugccuaucucuggggaaauggagaaagugaccggaugcacagucuucuguaccuuggccggccccggcgcuagcugcgaagccuauucagagaaugggauuuuuaacaucaguuccccaacuugucuagugaauaagguacagaaauucagaggaagcgaacaaaagauaaacuuuauuugccagaggauggaucaggacguuguggucuacuguaauggucagaagaaagugauccugacaaagacgcucgucaucggccaaugcauuuauaccuucacuucucuguucucacuuaugccugacguggcacauagucuggcuguugaguugugugugcccgggcuccacggaugggccacaguaaugcuguuaagcaccuuuugcuucggcuggauccugauuccagcgauaacacuugucgugcucaaauuucugaagauggccacuuucuccuguucucacuacaccaacgagucgaaauuuaagcuaaucuuggaaaagguuaaaguggaguaccagaagacgauggguagcauggucugcgauauuugccaucacgaaugugagaccgcaaaagugcuggaaucccauaagcagucaugcaucaacgggcagugucccuauugcaugacaaugacugaggcuaccgagagugcccuccaagcucacuacucuaucuguaaacugacaggccgguuccaggaagcccuuaaaaagagccugaaaaagccugagguaaaacgcggaugcuaucgaacuuugggcguguuuagauacaaguccagguguuauguugggcucgucuggugcgugcuguuaaccugugaacugauugugugggcagccucagcugagacgccacuacucgagagcggauggucugacacagcgcauggugucggcgaaauaccgaugaaaaccgaucuggagcuugacuucuccuugcccaguucuagcuccuacucauaucggcguaagcugacuaauccugcaaacaaggaagagaguaucccauuucacuuccagauggaaaaacagguuauucacgccgagauccaaacacucgggcauuggauggaugcuaccuuuaauauuaagacugccuuccacugcuacggagcaugucagaaauacagcuaucccuggcagaccgccaagugcuuuuucgagaaagacuaccaguaugaaacaggcugggguugcaacccuggggauuguccaggcgugggaacgggcugcaccgcuugugggguguaccuggacaaguuaaaaucgguaggaaaggccuauaagaucauaucccugaaauacacucgcaaggucugcauccaacuugguacagagcagaccuguaaacauauugaugcaaaugacugcuuggugacacccucuguuaagguguguaucgucggcacugugagcaaacuccagccgucagauacccugcuauuccuggggccucucgaacaaggaggcauuauccugaagcagugguggacgacaaguugcgcguuuggugacccaggggacauaauguccaccacuucuggcaugagaugucccgagcacaccggcagcuucaggaagauuugcggauuugcuacaacuccuguuugugaauaucaggggaacaccaucuccggauacaaacggaugauggccacaaaggauucauuccagagcuuuaaucuuacggacccccacauuaccacuaacaaauuggaguggaucgauccagacggcaauacacgagaucaugugaaccugguauuaaaucgcgacgucaguuuccaagaucucucugacaacccuugcaagguggaucugcacacccaggcaauagagggugccuggggguccggagugggcuuuacucuuacaugcaccgucggucugacggaaugucccagcuucaugacuucgaucaaggcuugcgacuuggccauguguuacggcucaaccguuacaaaucucgcaagagggucuaacaccgugaagguagugggaaagggcgggcauaguggauccagcuuuaaaugcugucacgauacugacugcucuagcgagggccuggucgcuuccgccccacaucuagaaagggugacagguuucaaucagauugauucagacaagguuuaugacgauggggcgccgccuuguaccuuucggugcugguucacaaaaaguggagaguggcugcucggcauccugaacgguaacuggauuguggucgugguucuuaucguggucuugauauuuagcauuguacuguucucuaucuuauguccccgcagaggccacaagaaagccguguga

SEQ ID NO: 10013 - RNA, 3426 nt, Artificial Sequence
  derived and/or modified CDS sequence (opt3) from BCCV__L39950.1__GP
augggcagacuguaccucaucgugcuugggguccugauuaccgccacagcuggauuccccaggagcguucacgaguugaagauagaaugcccucauacugugguauuaggucagggcuaugugacgggguccgucgagcugggauuuaucgcacuagaccaagugaccgaucucaaaauugaaucuucauguaguuucgaccaccaugccgcgccaacaacuacccagaacuuuacacagcugaagugggcuaaaaccgccagcacuacagauaccacgaaugcagccgagacuaccuucgaauccaagucuacagagguucaccuuaaaggcgugugcacuaucccgucgaacguccuggacggucccucacggccugugaccgggcgcaagacaguaguuuguuacgauuuggcuugcaaucagacccauugucaaccaacggugcaccuccuggcacccauucagacuugcaugagcguccgaaguuguaugaucucccugcucgccucucguauacaggugguguaugagaagacauacugcgucaccggacaguuaaucgaaggccuguguuuuaacccuguuccaaaucuugcuuugacucaacccggccacacauaugacaccuucacgcugccuauuaccugcuuucuaguggccaaaaagggggcgaaccucaaaaucgcaguagagcuggaaaaacuuacaacuaagaccggaugugccgagaaugcucugcaggccuacuauauuugcuucaucggucagcauagcgagccauugacagugccgaugcucgaagauuacagauccgcagagauauuuacuaggauuaugaugaaccccaagggcgaagaccacgauauggagcagucaagucaaggggcucugcggaucgucggaccuauuaagggcaaagugccacccaccgaaacaagcgacaccguucaggguaucgccuucgcgggguuaccuauguacucuuccuuuucaagccuggugcgcaaggccgagccagaguaucucuucagucccggaaucauugcagaaucuaaucauuccagcugcgauaaaaagacucuuccgcugacguggagaggcuuuuugucgaugucuggcgagauagaaaggaucacaggguguaacgucuucugcacccuagcuggaccuggugccuccugugaggcuuacucagaaaauggcauuuucaacaucaguagccccacuugccuggugaauaaaguacagaaguuucggggguccgagcaacgcauaaacuucauuucucagcgaaucgaccaggauguuaucguguauuguaauggacagaaaaaggucauucucaccaagacacuggugaucggccaaugcauuuacaccuuuacuagcauauucucacuuaucccaagugucgcccacucccuggcaguggaguuguguguuccugguauucacgggugggccacaaucgcucucgugaucacguuuugcuucggcuggcuguuaauucccaccacuacaaugguaguccugaaaugucuaagacuccugaccuauagcugcucucauuacucaacagaaaguaaguuuaaagugauacuugagaagguuaaaguggaauaucagaagacuaugggaagcauggucugugacaucugccaccaugagugcgaaaccgcgaaggaguuggagucccacaaaaagucuugugcagacggccagugcccauacuguaugacgauuaccgaagccacagagucggcucugcaggcccauuacgcagugugcaaacucacugggagguuccacgaagcccugaagaaaagccuuaagaagcccgagguacaacggggauguuaucguacccuggguguguuucgcuacaaauccagaugcuauguuggcuuggucuggaugugucuccugacauuagagcugaucgugugggcugccucagcagauacuccucuacucgaaccaggguggagugacaccgcgcacggagugggcgauauuccgaugaagacggaccuggagcuugauuucgcuauccccucuagcuccucauacagcuauaggcggcgauuggucaacccugccaacucugacgaaacaguuccauuucauuuccagcuggagcgccaggugauacacgcagaaauccagucccucggucauuggauggaugccaccuuuaauauuaucagugcuuuccacugcuacggggaguguaaaaaguauagcuaccccuggcaaacugccaaaugcuucuuugagaaggacuaccaguaugaaacaucuugguccuguaacccuccagauugccccggcgugggaaccggcugcacugcaugugggauuuaccuggacaaguuaaaaucaguaggaaaggcuuauaaagucaucacccugaaguacgccagaaaagugugcauacagcuugguacagagcagacguguaagaauauugauguuaacgacugcuuggugaccaguagcaucaaagucuguaugauuggcacuaucucgaaguuccaaccgggggacacacuccuguuucuaggaccucuggaagagggcggucucgugcugaagcaguggugcaccacaacuuguuccuucggggauccaggcgacauaaugucuaccacgagcggaaugaggugccccgaacacacaggcucauuucggaaaaucuguggguucgcgaccacuccuguuugcgaguaucagggaaauaccgugaguggcuuuaagcgccuuauggccacaaaagauuccuuccaaucuuuuaacguaagcgagguccauauuacuaccacaaaguuggaaugguccgaccccgauucaaauaucaaagaccacauuaaccugaucuuaaauagagaugugagcuuccaggaccucagugauaacccauguaagguggaccugucuacgcaggcuauagauggugcauggggguccggagucggcuuuacccuuacuugcauuguuggucugacagagugcagcucguucaugaccucaaucaaggugugugacauggccaugugcuacggcgcuucuguagugaauuuggucagggggaguaacacugugaaaaucguuggaaagggcgggcauuccggaagcacauuucguuguugccacgauaaagacuguaccucuaauggccuccuggccagcgcaccucaucuagaacgggugacggguuucaaccagauugacuccgauaaggucuaugacgauggggcgcccccaugcucaaucaaauguugguucgccaagaguggagaguggcugcucggcauucugaaugguaacugggugguuguggcuguccuuguaauaaucuugcugauuagcaucuuuuuauucuccuuuuucugcccgauucgaucucacaagaaacaacucuga

SEQ ID NO: 10014 - RNA, 3408 nt, Artificial Sequence
  derived and/or modified CDS sequence (opt3) from DOBV(DOBV/Ano-Poroia/Afl9/1999)__NC_005234.1__GP
augaucauguggggccugcuccuuaccaugauucugauagacuucggggccagcuugagaaacguguacgauaugaagaucgagugcccccacuccauuaauuuuggagaaucuucagucacagguaaaguugaguuaccuccacugcuacucacugacgcugaagcacuggugccggagaguagcuguaacauggauaaucaucaguccaugucuaucauucaaaagguaacgaaagugucguggaggaagaaagccgacaaggcgcaggcugccaaggauucauucgaaaccacaagcagugaggucaaccuuaaaggcacuugcgcacugucccaccggaugguggaggaaucuuaucgcaaucgacguagcguuaucuguuacgacuuguccugcaacucaacccauuguaagcccacaaugcacaugauagugccuguccauaguugcaauaugaugaaaagcugucucguggggcugggaccauauagaauccagauuguauacgagaggaccuauugcacuacaggcauccugaccgaagguaaguguuuuguucccgaucagucuauugugaacgucaucaaaaaugggguguucgacauagccuccgugucaauugucugcuuuuucauccggguuaagggaacgaacuacaagauuauggcuagcaucaaaacugcaaccgccaauaacuguaaugauacagacaacaaggugcaaggcuauuaccucugcaucguaggcgggaauaguucuccuguguacgcuccauccacuaccgauuuucgcagcauggaggccuuagcgucgcugcuuagagcaccccacggagaggaccacgauuugucuggugaagaggucgccacauauuccauugcuggccagauagaagggaaaaucccucauaccgccaacgcagcuaacaugcuguucacggccuuuucagggauuccaaguuacagcucccuaucuguguucaucggcagccaggacgguccgguuauauauucacccgggcucuuuccuaggcugaaucagaguuccugcgacaagauugcgcuuccacugaucugggagggauacaucgauuugcccggcuauuacgaaacugugcacccuuguaacgucuucugcgugcucagcggcccaggggccucuugugaggcauuuucagagggagguauuuucaauaucacaaguccgaccugccugguaagcaaacaaaaccgguuccgcgcugccgaacagcagguuaauuuugugugucagcgagucgaccaagauauugugauauauugcaacggccagaagaaaacuaucuuaacaaagacccuggucauugggcaguguaucuacuccgugacgucucucuucucgaucaugcccggaguugcucauagcauugccauagagcuuugcgugccuggcuuucacgguugggcaaccgccgcucuguugacaacuuucuguuuuggguggauccuaauucuguccaucacccucgcgguacuggucgugcuuaaguucuuugcagccauucugcacaauucaagucaagaaaacagauucaaaaucauauugaggaagaucaaagaggaauuugagaagacaaaaggcucuaugguuugcgagguguguaaguacgaaugcgagacuggaaaggaacucaaagcucauaaucugagcugcccccagucccaguguccauauugcuucacccacugugagccuacagaaucagccuuucaggcacauuacaaggucugccaagccacccaccgguuccgugacgaucugaaaaagacuauuacgccccagagcacaucuccaggcuguuaucgcaccuuaaaccuauuuagauacaaauccaggugcuauaucuucacuguguggguaacccuccugauuaucgagaguauaaugugggcugccagcgcaucugagacagugcuugaacccuccuggaaugacaacgcgcaugggguuggagucgugccuaugcacaccgauuuggagcuggacuucucacucccaaguagcucgaaguacacuuauaagcggaaacugacauccccgcuuaaucaggaacagucuguggaucugcacauugagaucgagagccaagguauuucaacgaguguccaugcuuugggccacugguuugacgggcgacucaaccugaagaccuccuuccauuguuacggagccugcacuaaauacgaauaucccuggcacacagcaaagugucacuuugagcgcgauuucgaauacgagaauaacuggggcugcaacccugccgacuguccagguaucgggaccggcugcacagcuugcggauuauauauagaccagcugaaacccguuggcucugccuacaagcuaaucacugugagauauagcaggaagguguguguacaguuuggggaagagaaucucugcaaaaccauugauaugaacgacuguuucgucacgcggcaugugaagguuugcaucauuggaaccguguccaaauuuucacagggugauacacuggucuuccuuggcccuauggagggaggaggcuugaucuuuaaggacugguguacuagcacaugccaauucggugauccaggggacauaaugagucccaaagauaagggcuuuucuuguccggacuucaccggacacuuucgcaaaaagugcaauuucgcaacuaccccugugugugaauacgauggcaacaugguuuccggguauaagaaagugauggcuacgauugacagcuuccagucguuuaauacaucaucuauccauuacaccgaugagagaaucgaauggaaggacccagauggaaugcugaaagaccaccucaacauucugguaacuaaggacaucgauuucgagaauuuaggcgaaaaccccugcaaagucggucugcagacaaguuccauugagggggccuggggaagcggcguggguuuuacccuuacuugucagauaucuuugaccgagugcagcagguuccucacauccaucaaggcgugcgacauggccauuuguuacggcgcucaaucagugacgcugauccgugggcagaauaccgucaagguuaguggaaaaggcgggcauagcggaucuuccuuuaagugcugucacggcacugauugcucacagcaaggucuacaggcaagugccccucaccuggacaaagugaacgggauuguagaacaggagagcgaaaagguguaugaugacggagcuccccaguguggcaucuccugcugguucgucaaaucuggugaguggauaacaggcaucuuuaaugggaacuggauugugaucguugugcucgucuucuuuuucauucugucgcuuaucuugcugagcuuacucuguccaauacggaagcauaagcgaucauga

SEQ ID NO: 10015 - RNA, 3408 nt, Artificial Sequence
  derived and/or modified CDS sequence (opt3) from DOBV(DOB/Saaremaa/160V)__AJ009774.2__GP
augaucauguggggccugcuccuuaccaugagccugauuaacuugggggccuccuuaagaaauguguacgacaugaagauagagugcccccacucuaucaacuucggagaaucaagugucacagguaaaguugagcugccuccaauucuacucacugaugcugaagcacuggugccggagagcuccuguaauauggacaaccaucagucucuuucgaucacgcaaaagguaaccaaagugucauggaggaagaaagccgaucagguccaggcggcuaaggacagcuuugaaacaacuucuaaugagauuaaccugaaggggaccugcacauugacccaccggaugguggaggaauccuaucgcaaucgaaaaucuguuaucuguuacgaucucagcugcaacuccacucauuguaagcccacaaugcacaugauagugccuguccauucaugcaauaugaugaaaaguugucugguggggcugggaccauaucguguacagguuguguacgagagaaccuauugcacgacuggcauccucaccgaagguaaguguuucguccccgaccaaagcauuaucucugugauuaaaaacgggguguuugauaucgccuccgucucaauaguuugcuucuuuauuagggugaagggaacaagcuacaagaucauggcaaguauuaaaacuucuaauccuaacaauuguaacgacaccgauaauaagguacagggcuauuacuuaugcaucgugggcgccaacuccagcccagucuacgcucccucgacaaccgacuuccggucuacggaggcacuggccucccuuuugcgcucaccucacggggaggaucacgaccugaguggagaagagguggcuacuuauagcaucgccggucagauugaaggcaaaauaccacauacagcgaacgcagccaauauggcuuuuaccgccuucuccgggaucccgucuuacagcucacuaaguguuuuugcaggaaaccaggauggcacuauuaucuucucccccggucucuuuccuaagcugaaucaaagcucuugcgacaaaguggcuuuaccacugauaugggagggguauauugacuugcccggauacuaugaaacaauccacccuuguaacgucuucugcgugcucucaggcccaggcgccaguugugaggcguuuagcgagggcggaaucuucaauauuaccucccccacgugccugguaucuaagcagaacagauucagggccgcagaacagcagaucaauuuuguuugucaacggguggaucaggacauugucauauacugcaacggucagaaaaagaccaucuuaacaaagacucuggugauuggccaauguaucuauucggucaccagccucuucuccaucaugccgucaguggcucauaguauugccauagagcuuugcguuccuggguuucacggaugggcuacagccgcacuguugacuaccuucuguuuuggcuggauccuaauucccucuaucacacuggccgugcucauuguacugaaauucuuugcugcgauccuucacaauagcucccaggaaaaccgcuucaagauaauccugcgaaaaauuaaggaggaauuugagaaaaccaaggguucaauggucugcgagguguguaaguacgaaugcgagacugggaaagaauugaaggcacauaaucucagcugcccacagucucaguguccuuacugcuucacgcacugugagcugacagaauccgccuuucaagcucauuauagaguuugccaggccacccacagguuccgggaugaccuuaaaaagacuaucacaccccagaguacaagcccaggcuguuaccguacccugaaccuauuucgcuauaaaucuagaugcuacauuuucacugugugggucgugcuccugaucauagaguccauucuuugggcagccucagcuagugaguugguacuggaacccaauuggaacgauaaugcccauggagugggcaucguuccuaugcacacagaccucgagcuggauuucagccuuccaucguccucuaaguauacguacaagaggaaacugaccagcccgauuaaccaggaacaaucaaucgacuugcacauagagaucgagagucaggggauuuccacuucuguccaugcacucggacacugguuugauggucggcugaacuuaaagaccagcuuccauuguuauggcgcgugcaccaaauacgaauaccccuggcacacagcuaagugucacuuugagcgagacuucgaauaugagaauaacugguccugcaauccuccagauugucccgggaucggaacuggcugcaccgccugcggucuguaccuagaccagcucaaaccuguggggucagcauauaagcugauuacggugcgcuacagcagaaaggucuguguucaguuuggcgaagagaaccuuugcaaaaccaucgacaugaaugauuguuucgugacaaggcaugugaagguaugcauaauuggaacugucaguaaauuuucucaaggcgacaccuugguguuccuggggccaauggagggagguggccucaucuuuaaggauugguguacaacuaccugccaguucggggaccccggagauaucauguccccgaaagacaagggcuuuagcuguccugauuucacgggucacuuucggaaaaagugcaacuucgccacaaccccaguuugugaauaugacgggaauauggugucgggcuacaagaaagucauggcuacuauugauucauuccaggccuuuaacacaucuuauauccauuacaccgacgagcagauugaauggaaggaucccgacggaaugcugaaagaucacuuaaauauacuggugacuaaggacaucgacuucgagaaccuuggcgaaaauccuugccgcguuggguugcaaaccgcaaguauugagggagcuuggggcuccggugugggguuuacacucacgugucagaucagccugaccgagugcucuagauuccuaacuagcauuaaagccugcgauauggcgaucuguuacggagcccaguccguaacacuggucaggggccaaaacaccgugaaggugucagguaagggcgggcauaguggaagcucuuuuaaaugcugucacggcaaugacugcucccagcaggggcuccaggcuucagcaccccaccuggauaaggucaacggaauaguugaacaagagaguacacagguguaugacgauggcgccccacagugugguaucagcugcugguucauuaaauccggggaauggaucaagggaauuuuuaguggcaauuggaucguaauagugguccuuauuguguuguucauccugucguuaauccuccugagcuuucuuuguccuauucguaaacauaagcggucauga

SEQ ID NO: 10016 - RNA, 3408 nt, Artificial Sequence
  derived and/or modified CDS sequence (opt3) from DOBV(East Slovakia/400Af/98)__AY168577.1__GP
augaucauguggggccugcuccuuaccaugauucugauagacuucgggacuagcuugagaaacguguacgauaugaagaucgagugcccccacuccauuaauuuuggagaaucuucagucacugguaaaguugaguuaccuccacugcuacucacggacgccgaagcucuggugccggagaguagcuguaacauggauaaucaucaguccaugucuaucauucaaaagguaaccaaagugucguggaggaagaaagcagacaaggcccaggcggcuaaggauucauucgaaacaacuagcagugaggucaaccuuaaagggaccugcacacugucccaccggaugguggaggaaucuuaucgcaaucgacguagcguuaucuguuacgacuuguccugcaacucaacccauuguaagcccacuaugcacaugauagugccuguccauaguugcaauaugaugaaaagcugucucguggggcugggaccauauagaauccagguaguuuacgagaggacauauugcaccacgggcauucugacugaagguaaguguuuugugcccgaucagucuaucgucaacgugauuaaaaaugggguguucgacaucgccuccgucucaauaguuugcuuuuucauucgggugaagggaaccaacuacaagaucauggcaagcauuaaaacagccacugcuaauaacuguaaugauaccgacaacaagguacaaggcuauuaccucugcaucgugggcgggaauaguucuccugucuacgcaccauccacaaccgauuuucgcagcauggaggccuuagcuucgcugcuuagagcuccccacggagaggaccacgauuugucuggugaagagguggcgacguauuccaucgcaggccagauugaagggaaaauaccucauacugccaacgcugccaacaugcuguucacagcauuuucaggaaucccaaguuacagcucccuaucuguuuauauuggcagccaggacgguccgguggucuacucacccggccucuucccuaagcugaaucagaguuccugcgacaaaguggcccuuccacugaucugggagggauauauagauuugcccggcuacuaugaaaccguacacccuuguaacguguuuugcguucucagcggcccaggggccucuugugaggcguucucagagggagguauuuuuaauaucacaagucccacaugccuggucagcaagcaaaacagguuccgggccgcagaacaacaggugaauuucgucugucagcgcguggaccaggauaucguuauuuacugcaacggccagaaaaagaccaucuuaacgaagacccuggugauugggcaguguauauacuccguaacaucucucuuuucgaucaugccgggagucgcucauagcauugccaucgagcuuugcgugccuggcuuccacgguugggcuacugccgcacuguugaccacauuuuguuucggguggauccuaauucccuccauaacucuggccguucucgugguccugaaauuuuucgcugcgauccuucacaauucaagucaagaaaaccgauuuaagauuauccugagaaaaauuaaggaggaguucgagaaaaccaagggcucuauggugugcgagguauguaaguaugaaugcgagacaggaaaagaauugaaggcacauaaucucagcugcccacagucccaguguccuuacugcuuuacccacugugagcccacugaaucagccuuccaggcucauuauaaagugugccaagccacgcacagguuucgggacgaucugaagaaaacaaucaccccacagagcacuucucccggcuguuaccguaccuuaaaccuguuccgcuauaaguccagaugcuacauauuuacaguuugggucacccuacucaucauugagaguaucaugugggcagccagcgcuucugagaaugugcuggaaccuuccuggaacgacaaugcccauggggugggagucguuccaaugcacacugaucuugaguuggacuucucacugccgaguagcucgaaguauacauacaaaaggaagcucacgucuccccugaaccaggaacaguccguggaucuucacauugagaucgagagccaagguauaucaaccagugugcaugcacugggccacugguucgacgggcgguugaaucucaaaacuuccuuucauuguuacggagcgugcacaaaguaugaauacccuuggcacaccgcuaaaugucacuucgagcgagauuuugaauaugagaacucuuggggcugcaacccagccgacugucccgguauugggacaggcugcacugcaugcggacuguacaucgaccaguuaaagccuguaggcagcgccuauaagcugauuaccguccgcuacuccagaaaaguguguguucaguucggggaagagaaucuaugcaagacgaucgauaugaacgacuguuuugugaccaggcaugucaaagugugcauaaucggaacaguuucaaaguucagccagggugauacucucguguuucugggcccaauggaagggggaggccuuauuuucaaagacugguguaccaguacaugccaauuuggugaucccggggacaucaugucuccgaaggauaaaggcuucuccuguccugacuuuacuggacacuuccggaagaagugcaauuuugcuaccacgccaguaugugaauaugauggcaacauggucagcggguacaaaaaggugauggccacaauugacucguuccagucauucaauaccucuaguauccauuacacugaugagcgcauagaauggaaagaccccgauggaauguugaaggaccaccugaacauucucgugacaaaagacaucgauuuugagaaucugggcgaaaacccuugcaaggucgguuuacagaccuccagcaucgagggggcauggggaucuggcguugguuucacucugaccugucagauuagccuuacagagugcuccagauuuuugacgucaaucaaggcuugcgacauggccauuuguuauggcgcgcaaagugugacccucauaagggggcagaauacuguaaaagugagcggaaagggcgggcauucuggauccucauucaaaugcugucacggcacagauugcagucagcaaggucugcaggccagcgcuccccaccuagacaaggucaacgggaucguggaacaggaguccgaaaaaguuuacgaugacggagcaccacaguguggcauuucuugcugguuugugaagucgggugaguggaucaccggcauuuucaaugggaacuggaucgucauagugguucugaucuuuuucuuuauucucagccugauccuuuugucacuguuauguccuauucguaagcauaaacgguccuga

SEQ ID NO: 10017 - RNA, 3408 nt, Artificial Sequence
  derived and/or modified CDS sequence (opt3) from DOBV(East Slovakia/862Aa/97)__AY168578.1__GP
augaucauguggggccugcuccuuaccaugagccugauuaacuugggggccuccuuaagaaauguguacgaccugaggauagagugcccccacucuaucaacuucggagaaucaagugucacagguaagguugagcuaccuccaauuccgcucacugaugcugaaacgcuggugcccgagagcuccuguaauauggacaaccaucagucucuuucgaucacccaaaaaguaacaaaggugucauggcggaaaaaggcagauaaaguccaggccgcgaaggacagcuuugaaacuaccaguuccgagauuaaucugaagggcacaugcaccuuggcucaccgcaugguggaggaaucuuaucgaaaccguaaaagcguuaucuguuacgaucucuccugcaauucaacucauuguaagccuacaauguauaugauagugccaguccacaguugcaacaugaugaaaagcugucugguggggcugggacccuacagaauccagguaguuuaugagaggaccuacugcacgacuggcauucucaucgaagguaaguguuucgugccugaccagucuauuaucuccgucauaaagaaugggguguuugauauugccucagugagcaucgucugcuucuuuauucggaucaagggaaacaguuauaagaucaugaccaauauuaaaacagcaaacccaaauaacuguaaugacacugauaacaagguucaaggcuacuacuuaugcauagugggcgccaacucuucccccguauaugcuccuagcaccacagacuuccgcucgauggaggugcuggcaucucuuuugagauccccacauggggaggaucacgaccugucaggagaagaggucgccaccuacaguaucgcuggucagguggaaggcaaaguuccgcacacggagaaugccgcgaacaugcuauuuacugcauucagcgggauucccuccuauucuagccucucaguguuugccggaaaucaggauggcacagucaucuacaguccuggucuguucccaaaacuuaaccaguccagcugcgaaaaaguggcucugcccuugauaugggagggguauauugaccucccuggauacuaugagaccauccauccauguaauguauuuugcguucugucuggccccggcgccucaugugaagcauucagugaagggggaaucuuuaacauuacuagcccgacaugcuuaguguccaagcaaaauagguuccgggcugccgaacagcagaucaacuucgucugucagcgcguggaccaagauauugucauauacugcaauggucagaaaaagaccauccugacgaagacccucgugauuggccaguguaucuacucuguuacaucgcuuuuuagcaucaugccugggguggcgcacuccauugccauagagcugugcguacccggauuccauggcugggcaacugcugccuugcuaaccacauuuuguuucgguuggauccugauuccaucaaucacucucgcuauucugaucguccuuaaauuuuucgccgcaauacugcacaacaguucucaagaaaaucgauuuaaggugaucuugagaaaaauuaaggaggaguucgagaaaaccaaggggagcaugguuugcgagguguguaaguaugaaugcgagacaggcaaagaacucaaggcccacaaccuguccugcccucagucacagugucccuacugcuuuacccauugugaguuaacugagagcgcuuuccaggcgcacuauagggucugccaagcaacgcaucgguuucgugacgaucugaaaaagacaaucaccccacagucuacuucccccggauguuaccgcacccuaaaucucuucagauauaaaaguaggugcuacauuuuuacaguguggguagugcugcuuaucauagaaagcauuuugugggccgcuucugccuccgagaucguucuggaaccuucauggaacgacaaugcacacggcgucgggguggugccaaugcauaccgaucucgagcuggacuucagucuuccgagcucguccaaguauacuuacaagcggaaacugacaucucccauuaaccaggagcagagcgucgauuugcacaucgaaauagagucacaacgaaucaguacguccguucacgcccucggacauugguucgacggucgccugaacuuaaagaccucuuuucacuguuacggcgcuugcacuaaauaugaauacccuuggcauacagccagaugucacuucgagagggauuuugaauaugagaauagcugguccugcaacccagcagacugucccgggauuggaaccggcugcacagcgugcggucuguaccuagaucagcucaagccuguggggucagcuuauaaacugaucacugugcgguacagccgcaagguauguguccaguucggcgaggaaaaucuuugcaagauuaucgacaugaacgacuguuuugugaguagacacguuaaagugugcauaauuggaaccgucucuaaguucucccagggcgauacguugguguuucuggggccaauggagggagguggccucaucuucaaagacugguguaccacaacuugccaauuuggggaucccggagacaucaugagcccgaaggauaaaggcuucucguguccugacuuuaccggucauuucaggaagaaaugcaauuuugccacaacuccaguuugugaauaugaugggaacauggugucaggcuacaagaagguaauggcaaccauugacucuuuccaggccuucaauacgaguuacauccacuauacagaugagcguauugaauggaaagaccccgauggaaugcugaaggaccauauaaacaucuuagucaccaaagauauugacuuugagaaucugggcgagaacccuugcaagguggggcuucagacugcuuccaucgaaggagccuggggcagcggugugggguucacauugaccugucagauuucucucacugagugcagccgguuucugaccuccaucaaagcaugcgacauggcuauauguuacggagcccaaucagucacgcuaguucgaggccagaauacagugaagguaagugguaagggcgggcacagcggaucuuccuucaaaugcugucauggcaccgauugcucacagcaagggcugcaggcgagugcuccccaccucgacaaggugaacggaaucgucgaacaggagagcacucagguguaugaugacggcgccccacaaugugguauuuccugcugguuuaucaaaucuggggaauggauuaagggaaucuucaauggcaacuggauaguuauugugguccugaucuuuuucuuuauccuuucguugauucugcucagcuucuuauguccuauaagaaaacacaagaggucauga

SEQ ID NO: 10018 - RNA, 3408 nt, Artificial Sequence
  derived and/or modified CDS sequence (opt3) from DOBV(A35)__GU904036.1__GP
augaucauguggggccugcuccuuacccugagcuugauuuccuuaggggccucucugagaaacguguacgaccuaaggauagagugcccccacucaaucaauuucggagaaaguagcgucacagguaagguugagcucccuccaauuccgcugacugaugcugaaacgcuugugcccgaguccucuuguaacauggacaaucaucagucgcugucaaucacccaaaaaguaacaaaggugagcuggcggaaaaaggcagauaaaguccaggccgcgaaggacaguuuugaaacuaccuccucugagauuaacuugaagggcacaugcacccucgcucaccgcaugguggaggaaagcuaucgaucccguaaaucaguuaucuguuacgaucugaguugcaauagcacucauuguaagccuacaauguauaugauagugccaguccacucuugcaacaugaugaaauccugucugguggggcucggacccuacagaauccagguaguuuaugagaggaccuacugcacgacuggcauuuuaaucgaagguaaguguuucgugccugaccagucaauuaucagcgucauuaaaaaugggguguuugauauagccagugugucuaucgucugcuucuuuauucggaucaagggaaacuccuauaagaucaugaccaauauuaaaacagcaaacccaaauaacuguaaugacacugauaacaagguucaaggcuacuaccugugcauagugggcgccaauagcucgcccguauaugcuccuucuaccacagacuuccgcuccauggaggugcuugcaucauugcugagaaguccacauggggaggaucacgaccuaagcggagaagaggucgccaccuacuccaucgcuggucagguggaaggcaaaguuccgcacacggagaacgccgcgaacaugcucuuuacugcauucucugggauucccagcuauucaagucuguccguguuugccggaaaucaggauggcacagucaucuacagcccuggucuuuucccaaagcugaaccagucuucaugcgaaaaaguggcuuugccccucauaugggagggguauauugaccugccuggauacuaugagaccauccauccauguaauguauuuugcguuuuaaguggccccggcgccagcugugaagcauucuccgaagggggaaucuuuaacauuacuucuccgacaugccuggugucgaagcaaaauagguuccgggcugccgaacagcagaucaacuucgucugucagcgcguggaccaagauauugucauauacugcaauggucagaaaaagaccauccucacgaagacccuugugauuggccaguguaucuacagcguuacaucccuguuuucaaucaugccugggguggcgcacaguauugccauagaguugugcguacccggauuccauggcugggcaacugcugcccuacugaccacauuuuguuucgguuggauccucauuccaucuaucacucuggcuauucuuaucguccugaaauuuuucgccgcaauauugcacaacagcucccaagaaaaucgauuuaaggugauccucagaaaaauuaaggaggaguucgagaaaaccaaggggucaaugguuugcgagguguguaaguaugaaugcgagacaggcaaagaacugaaggcccacaacuuaagcugcccucagucucagugucccuacugcuuuacccauugugagcugacugaguccgcuuuccaggcgcacuauagggucugccaagcaacgcaucgguuucgugacgaucucaaaaagacaaucaccccacagaguacuagccccggauguuaccgcacccuaaaucuguucagauauaaaucuaggugcuacauuuuuacaguguggguagugcuuuugaucauagaauccauucugugggccgcuucagccagugagaucguucucgaaccuagcuggaacgacaaugcacacggcgucgggguggugccaaugcauaccgaucuggagcuugacuucucgcugccguccucuagcaaguauacuuacaagcggaaauugacaucacccauuaaccaggagcagagugucgaucuccacaucgaaauagagucccaacgaaucucuacgagcguucacgcccugggacauugguucgacggucgcuuaaaucugaagaccuccuuucacuguuacggcgcuugcacuaaauaugaauacccuuggcauacagccagaugucacuucgagagggauuuugaauaugagaacucauggagcugcaacccagcagacugucccgggauuggaaccggcugcacagcgugcggucuauaccucgaucagcugaagccuguggggagugcuuauaaacuuaucacugugcgguacucucgcaagguauguguccaguucggcgaggaaaauuugugcaagauuaucgacaugaacgacuguuuuguguccagacacguuaaagugugcauaauuggaaccgucagcaaguucucgcagggcgauacgcugguguuucucgggccaauggagggagguggccugaucuucaaagacugguguaccacaacuugccaauuuggggaucccggagacaucaugucaccgaaggauaaaggcuucucuuguccugacuuuaccggucauuucaggaagaaaugcaauuuugccacaacuccaguuugugaauaugaugggaacauggugaguggcuacaagaagguaauggcaaccauugacuccuuccaggccuucaauacgagcuacauccacuauacagaugagcguauugaauggaaagaccccgauggaauguuaaaggaccauauaaacauccuggucaccaaagauauugacuuugagaaucuuggcgagaacccuugcaaggugggguugcagacugcuucuaucgaaggagccuggggcagcggugugggguucacacucaccugucagauuucccugacugagugcucacgguuucuaaccaguaucaaagcaugcgacauggcuauauguuacggagcccaaagcgucacacugguucgaggccagaauacggugaagguaucugguaagggcgggcacuccggaucaaguuucaaaugcugucauggcaccgauugcagccagcaagggcuccaggcguccgcuccccaccuggacaaggugaacggaaucgucgaacaggagucuacucagguguaugaugacggcgccccacaaugugguauuucgugcugguuuaucaaaagcggggaauggauuaagggaaucuucaauggcaacuggauaguuauugugguccuuaucuuuuucuuuaucuugucacugauuuuacucuccuuccuguguccuauaagaaaacacaagaggaguuga

SEQ ID NO: 10019 - RNA, 3408 nt, Artificial Sequence
  derived and/or modified CDS sequence (opt3) from DOBV(A6)__GU904033.1__GP
augaucauguggggccugcuccuuaccaugauucugauagacuucggggccagcuugagaaacguguacgauaugaagaucgagugcccccacuccauuaauuuuggagaaucuucagucacagguaaaguugaguuaccuccacugcuacucacugacgcugaagcacuggugccggagaguagcuguaacauggauaaucaucaguccaugucuaucauucaaaagguaacgaaagugucguggaggaagaaagccgacaaggcgcaggcugccaaggauucauucgaaaccacaagcagugaggucaaccuuaaaggcacuugcacccugucccaccggaugguggaggaaucuuaucgcaaucgacguagcguuaucuguuacgacuuguccugcaacucaacacauuguaagcccaccaugcacaugauagugccuguccauaguugcaauaugaugaaaagcugucucguggggcugggaccauauagaauccagguagcauacgagaggacuuauugcacaaccggcauucugacggaagguaaguguuuuguucccgaucagucuaucguguccgucauuaaaaacgggguguucgacaucgccucagugagcauagucugcuuuuucauucggguuaagggaacuaauuacaagaucauggcuaguauuaaaaccgcaacagccaacaauuguaacgauacugacaauaaggugcaaggcuauuaccucugcaucguaggcgggaacucuuccccuguguacgcuccaagcaccacagauuuucgcucgauggaggccuuagcgucucugcuuagagcaccccacggagaggaccacgauuuguccggugaagaggucgccaccuauucaaucgcuggccagauugaagggaaaauaccucauacggccaaugcagcuaacaugcuguucacugccuuuaguggaaucccaagcuacuccucucuaagcguguucauuggcucacaggacgguccgaucauauauagucccgggcucuuuccuaagcugaaccaguccagcugcgacaaaguugcgcuuccacugauuugggagggauacaucgauuugcccggcuauuacgaaacagugcacccuuguaaugucuucugcgugcucucuggcccaggggccucaugugaggcauuuagugagggagguaucuucaacauuaccagccccacuugccugguauccaagcaaaauagguuccgggcugccgaacagcagguuaacuuugugugucagcgcgucgaccaagauaucauuauauauugcaauggccagaaaaagacaaucuuaaccaagacgcuggugauugggcaguguaucuacucugucaccagccucuucucgaucaugccgggaguggcucauuccauugccauagagcuuugcguuccuggcuuucacgguugggcaacagccgcucuguugacuaccuucuguuuuggguggauccuaauucccucaaucacacuggcggugcucguaguccugaaauucuuugcagccauucuucacaacaguucucaagaaaaucgauucaagaucauacugagaaaaaucaaggaggaauuugagaaaacuaagggcagcauggugugcgagguuuguaaguacgaaugcgagaccggaaaagaauugaaggcucauaaccucuccugcccacagucacaguguccuuauugcuucacacacugugagcccaccgaaagcgccuuucaggcacauuacaaagugugccaagccacucacagguuccgggacgaucugaagaaaacgauuacaccacagucuaccucccccggcuguuaucguacuuuaaaucuguuucgcuacaagaguagaugcuauaucuucaccgucugggugacacuacucauuaucgagagcauaaugugggcugccucugcauccgagaacguacuggaaccuucauggaaugacaacgcgcauggggugggaguugucccaaugcacaccgaucuugaguuggacuucagucugccgagcucguccaaguacacuuauaaaaggaagcucacaucuccccugaaucaggaacagagcguggaucuucacauugagaucgagucacaagguauuaguacguccgugcaugcucugggccacugguuugacgggcgguugaaccucaaaaccucuuuccauuguuacggagccugcacuaaguacgaauauccuuggcacacagcaaaaugucacuuugagcgagauuucgaauacgagaauagcuggggcugcaacccagccgacugucccgguaucgggaccggcugcacagcuugcggacuguauauagaccaguuaaagccugucggcuccgccuacaagcugaucacuguucgcuauucaagaaaagugugugugcaguuuggggaagagaaccuaugcaagaccauugauaugaaugacuguuucguaacgaggcaugucaaagugugcaucauuggaaccguuagcaaguuuagucagggugauacacucguguuccugggcccaauggucgggggaggccuuaucuuuaaagacugguguacuucuaccugccaauucggugaucccggggacauaauguccccgaaggauaaaggcuuuagcuguccugacuucacaggacacuuucggaagaagugcaacuucgcaacuaccccagugugugaguacgauggcaauaugguuucgggguauaaaaaggugauggcuacgauugacucauuccagucuuuuaacacaaguuccauccauuacaccgaugaacgcaucgaguggaaagaccccgauggaauguugaaggaccaccugaauauucucguaacuaaagacaucgauuucgaaaaccugggcgagaauccuugcaaggucgguuuacagacaagcucuauugaaggggccuggggaagcggcguggguuuuacccugacuugucagauaucccuuaccgagugcucaagauucuugacaaguaucaaggcgugcgacauggccauuuguuacggcgcucaaagcgugacgcucaucagggggcagaacaccgucaaaguuucuggaaagggcgggcauuccggaucaaguuuuaaaugcugucacggcacugauugcagccagcaaggucugcaggcauccgcuccccaccuagacaaggugaaugggauuguagagcaggauucugaaaaaguguaugacgauggagccccacaguguggcaucucgugcugguucgucaagagcggugaguggauaacaggcaucuuuaacgggaauuggauugugaucguugugcuggucuucuuuuucauucucucacugauccuuuugucccuguuauguccuauacguaagcauaaacggaguuga

SEQ ID NO: 10020 - RNA, 3408 nt, Artificial Sequence
  derived and/or modified CDS sequence (opt3) from DOBV(B13)__GU904034.1__GP
augaucauguggggccugcuccuuaccaugauucugauagacuucggggccagcuugagaaacguguacgauaugaagaucgagugcccccacuccauuaauuuuggagaaucuucagucacagguaaaguugaguuaccuccacugcuacucacugacgcugaagcacuggugccggagaguagcuguaacauggauaaucaucaguccaugucuaucauucaaaagguaacgaaagugucguggaggaagaaagccgacaaggcgcaggcugccaaggauucauucgaaaccacaagcagugaggucaaccuuaaaggcacuugcacccugucccaccggaugguggaggaaucuuaucgcaaucgacguagcguuaucuguuacgacuuguccugcaacucaacacauuguaagcccaccaugcacaugauagugccuguccauaguugcaauaugaugaaaagcugucucguggggcugggaccauauagaauccagguaguuuacgagaggacuuauugcacaaccggcauucugacggaagguaaguguuuugugcccgaucagucuaucgucuccgugauuaaaaacgggguguucgacaucgcaucagucagcauaguuugcuuuuucauucgggugaagggaacuaauuacaagaucauggccaguauuaaaaccgcuacagcaaacaauuguaacgauacugacaauaagguacaaggcuauuaccucugcaucgugggcgggaacucuuccccugucuacgccccaagcaccacagauuuucgcucgauggaggcuuuagccucucugcuuagagcgccccacggagaggaccacgauuuguccggugaagagguggcaaccuauucaaucgccggccagauugaagggaaaauaccucauacggcuaaugccgcaaacaugcuguucacugcuuuuaguggaaucccaagcuacuccucucuaagcguuuucauuggcucacaggacgguccgaucauauauagucccgggcucuuuccuaagcugaaccaguccagcugcgacaaaguggcccuuccacugauuugggagggauacaucgauuugcccggcuauuacgaaacaguccacccuuguaauguguucugcguacucucuggcccaggggcgucaugugaggccuuuagugagggagguaucuucaacauuaccagccccacuugccugguuuccaagcaaaauagguuccgggcagcugaacaacaggugaacuuugucugucagcgcguggaccaggauaucauuauauauugcaauggccagaaaaagacaaucuuaaccaagacgcuggucauugggcaguguaucuacucugugaccagccucuucagcaucaugccgggaguugcccauuccauugcuauagagcuuugcgugccuggcuuucacgguugggccacagcagcccuguugacuaccuucuguuuuggguggauccuaauucccucaaucacacuggcuguacucgucgugcugaaauucuuugcggcaauucuucacaacaguucucaagaaaaucgauucaagaucauacugagaaaaaucaaggaggaauuugagaaaacuaagggcagcaugguuugcgagguguguaaguacgaaugcgagaccggaaaagaauugaaggcccauaaccucuccugcccacagucacaguguccuuauugcuucacacacugugagcccaccgaaagcgcuuuucaggcccauuacaaagucugccaagcaacucacagguuccgggacgaucugaagaaaacgauuacaccacagucuaccucccccggcuguuaucguacuuuaaaucuguuucgcuacaagaguagaugcuauaucuucaccguguggguaacacuacucauuaucgagagcauaaugugggccgcuucugccuccgagaacgugcuggaaccuucauggaaugacaacgcacaugggguuggagucgugccaaugcacaccgaucuugaguuggacuucagucugccgagcucguccaaguacacuuauaaaaggaagcucacaucuccccugaaucaggaacagagcguggaucuucacauugagaucgagucacaagguauuaguacguccguccaugcgcugggccacugguuugacgggcgguugaaccucaaaaccucuuuccauuguuacggagcuugcacuaaguacgaauauccuuggcacacagccaaaugucacuuugagcgagauuucgaauacgagaauagcuggggcugcaacccagcagacugucccgguaucgggaccggcugcacagccugcggacuguauauagaccaguuaaagccuguuggcuccgcuuacaagcugaucacugugcgcuauucaagaaaaguguguguacaguuuggggaagagaaccuaugcaagaccauugauaugaaugacuguuucgucacgaggcaugugaaaguuugcaucauuggaaccgugagcaaguuuagucagggugauacacucgucuuccugggcccaaugguugggggaggccuuaucuuuaaagacugguguacuucuaccugccaauucggugaucccggggacauaauguccccgaaggauaaaggcuuuagcuguccugacuucacaggacacuuucggaagaagugcaacuucgccacuaccccagugugugaguacgauggcaauauggugucgggguauaaaaagguaauggcaacgauugacucauuccagucuuuuaacacaaguuccauccauuacaccgaugaacgcaucgaguggaaagaccccgauggaauguugaaggaccaccugaauauucucgucacuaaagacaucgauuucgaaaaccugggcgagaauccuugcaagguggguuuacagacaagcucuauugaaggggcuuggggaagcggcguggguuuuacccugacuugucagauaucccuuaccgagugcucaagauucuugacaaguaucaaggccugcgacauggcgauuuguuacggcgcccaaagcgucacgcucaucagggggcagaacaccguuaaagugucuggaaagggcgggcauuccggaucaaguuuuaaaugcugucacggcacugauugcagccagcaaggucugcaggcuuccgcaccccaccuagacaagguaaaugggauuguggagcaggauucugaaaaagucuaugacgauggagccccacaguguggcaucucgugcugguucgugaagucgggugaguggauaacaggcaucuuuaacgggaauuggauuguuaucgugguccugguguucuuuuucauucucucacugauccuuuugucccuguuauguccuauacguaagcauaaacggaguuga

SEQ ID NO: 10021 - RNA, 3408 nt, Artificial Sequence
  derived and/or modified CDS sequence (opt3) from DOBV(Aa1854/Lipetsk-02)__EU188453.1__GP
augaucauguggggccugcuccuuaccauggcccugauuaaccccggggcuacauugagaaauguguacgacaugaggauagagugcccucacagcaucaacuucggagaauccucugucacugguaagguugaguuaccaccgauuccccuggcagaugccgaaacgcuagugccugagucaaguuguaauauggacaaccaucagagccucuccaucacccaaaaaguaacaaaggugucuuggcggaaaaaggcggauaaaguccaggcugccaaggacucguuugaaacuaccucaagcgagauuaaucugaagggcacaugcacccuuacucaccgcaugguggaggaaaguuaucgaaaccguaaauccguuaucuguuacgaucugucuugcaauagcacacauuguaagccaaccaugcacaugauagugcccguccauuccugcaacaugaugaaaucauguuugguggggcucggaccuuauagaauccagguaguuuacgagaggacguauugcacuaccggcauucugacagaagguaaguguuucgugccagaccagaguaucgucagcgugauuaaaaaugggguguuugauaucgcaucugucuccauaguuugcuucuuuauucggaucaagggaaacucauacaagauuauggccagcaucaaagaggcuaaucccaacaauuguaacgacacugauaauaaggugcaaggcuauuaccugugcaucguaggcgcaaacaguucuccuguguacgccccauccaccacagacuuccgcagcgucgaggcucucgccucguuacugagaucuccgcacggggaagaucacgaccuuuccggagaggaaguggcgaccuauucaauugcaggucagguugagggcaaagugccccauacggccaacgcugccaauauguuguuuacugcauucagugggauaccuagccacuccucuuuuagcgucuucacaggaaaccaggauggcaccgugaucuacucaccaggucuguuucccaagcuaaaucagagugcuugcgacaaaguagcccucccucugauuugggaaggguauaucgaccuuccaggauacuaugagacuauacaucccuguaacguuuucugcgugcuguccggcccgggcgcgagcugugaggccuuuucugaagggggaauuuucaauaucacaucaccuaccugcuuggucaguaagcaaaacagguuccgggcagcugagcagcagaucaauuuugugugucagcgcgucgaucaagacauugugaucuacugcaacggucagaaaaagacgauucucaccaagacacugguuauaggccaguguaucuauagcgugacuuccuuauucucuauuaugcccgggguagcccacucgaucgcuaucgaacugugcgucccaggauuucacggcugggccaccgcagcccuccuuacaacuuucuguuuugguuggauucugauaccuagcaucaccuuggcuauucuaaucgugcugaaauucuuugcggcaauucuccauaauuccucacaagagaaccgauucaagaucauacugagaaaaaucaaggaagaguuugagaggacaaaagggaguaugguuugcgaaguguguaaguacgagugcgaaaccggcaaggagcuuaaagcccacaaucugucuugcccccagagccaguguccauacugcuucacucauugugaauugacggaguccgcuuuucaggcccacuaucgggucugccaagcaacacaucguuuccgcgaugaccucaagaaaaccauuacuccccagucaaccagcccuggauguuacagaacacugaacuuauuuagguauaagucucggugcuacaucuucaccguguggguagugcugcuaauuaucgaguccauacucugggccgcuagugccagcgaaacuguucuggagccaaauuggaacgauaaugcacacggcgucgggguggugccgaugcacacagaccuugaauuggauuucucucugcccuccucaaguaaauauacguacaagcgaaagcucaccagcccuauuaaccaggagcagucggucgaccugcauaucgagguugaaucccaaggaauuucuacuagcgugcacgcgcuuggucauugguuugauggccgccugaacuugaaaacaucauuccacuguuauggggcuugcaccaaguacgaguacccauggcacacagccagaugucauuuugaaagggacuucgaguaugaaaauaguugguccugcaaccccgcagauuguccuggaaucggcacugguugcaccgccugcgggcucuaccuggaccaguuaaaaccagugggcucugcuuauaagcugauaacgguacgguacagccgcagagucugugugcaguuuggagaggagaaucuaugcaaaaccaucgacaugaacgauuguuucguuacaaggcacgugaaggucugcauuaucggcacuguguccaaguuuucacagggggacacccucguuuuccugggacccauggaagguggcgggcuuauuuuuaaagauugguguacaacuaccugccaauucggagacccgggcgauaucaugagcccuaaggacaaagguuuuaguuguccagauuucacggggcauuuucguaagaaaugcaauuucgccacaacccccgugugugaguaugacggcaacaugguaucuggauacaagaaagucauggcaacuauagauuccuuccaggcuuuuaauacaagcaacauucacuauaccgacgaacggaucgaguggaaggauccugacggcauguugaaggaucaucugaauauccucgugacuaaagacauugacuucgaaaaccugggggagaaucccugcaaggugggauuacagaccgccucgaucgagggcgcgugggguucaggggucggauuuacacugacgugucagauuucucuuaccgaaugcagucgauucuugacuuccauaaaagccugcgauauggcuaucuguuacggcgcacaaagcguuacacucgugagaggucagaacaccguaaaggugucuggcaaagggggacacagcggcuccucauuuaagugcugucacgggacagacugcagucagcaaggacugcaggccagcgcuccacaucuagauaaggucaauggcauuguggagcaggaaucuacucagguuuacgacgauggugccccucaaugugggaucuccugcugguucauuaaaucaggagaguggaucaagggcauauuuaacgguaauuggaucgugauugucgugcugaucuucuuuuucauucucagucugauccuuuugagcuuucugugucccauaaggaaacacaagcgcuccuga

SEQ ID NO: 10022 - RNA, 3402 nt, Artificial Sequence
  derived and/or modified CDS sequence (opt3) from DOBV(Ap/Sochi/hu)__JF920149.1__GP
auguggggccugcuccuuaccaugauccugauugacuucggggccacauugagaaacguguacgauaugaggauagagugcccccacagcgucaauuuuggagaauccucuguuucagguaagguggaguuaccuccaguacugcuaagugaaguggagacucucgucccggaaagcuccuguaacauggacaaucaucagucuaugucgaucauucaaaaagugacgcagcugaccuggcggaagaaagccgauaaggcacaggccgcgaaagacucauucgagaucacaagcggcgagguuagucuuaaggggacuugcacccugacacaccgcaugguggaagauucccaucgaaaccguaagucuauuaucuguuaugacuugagcugcaauuccacccacuguaaacccacuaugcauaugauagucccuauccacucaugcaacaugaugaagaguugucucgugggacugggcccauacaggauucagguaguuuaugagagaacauacugcaccacggguauccugacugaagggaaauguuuugugcccgaucaaagcauugucaaugugaucaagaacggaguguucgacauagcuucugucuccauuguuugcuuuuucgugcggguaaaaggcaccaauuauaagaucauggccucaauuaagacagcaacuagcaacaauuguaacgauaccggcaauaaagugcagggguacuaucucugcaucgucggagguaacaguucuccuguguacguuccauccacaaccgacuuucgcagcauggaggccuuagcuucgaugcugagagcaccccacggcgaggaucaugaccuugccggggaagagguggcuacguacucuaucgccggacaggucgaaggcaaggugccucacacugcguccacagcaaauauguugcugaccgccuucucagguauuccaaguuauagcucccuaucuguauuuacugggagccaggauggaccgauaguuuacucacccggccucuucccuaaacugaaccaaaguuccugcgacaaggugggccuuccacugaucugggagggguauauugacuugcccggauacuaugaaacaguccaucaguguaacguguuuugcguccucagcgguccuggcgcuucuugugaggccuucucagaagggggaaucuuuaauauaaccaguccaaacugcauggugagcaaacagaauagguuccgggcagcugaacagcaaguuaacuucgccugucagcgcguggaucaggacauucugaucuuuugcaauggccaaaagaaaacgaucuuaaccaagacacugguaauuggucaguguaucuacuccauuacuucucucuucucgauaaugcccggggucgcgcacagcaucgccauugagcuuugcgugccgggcuuucacggaugggcaaccgcugcccuguugacaacuuucuguuuuggcuggguucuaaucccuuccaucacccuggcugugcucgucgugcugaaguucuuugccgcaauucuucauaacucaagucaggaaaaucgauucaaacugauauugaagaaaaucaaggaggaauuugagaaaacaaaggggucuaugguaugcgagguguguaaguaugaaugcgagaccggaaaagaacucaaggcccacaaccugagcugcccccagucccaauguccauacugcuucacucauugugagccuacggaaucagcuuuucaggcgcacuacaaaguuugccaggcaacacauagauucagggaugacuuaaagaaaaccauuacuccccagagcaccucuccagguuguuaucggacacugaaucuauuucguuacaagucccgcugcuauaucuucaccgucuggguggugcuccuggucguugagagugugaugugggccgcuagcgccucugagacugugcuugaacccuccuggaacgauaaugcacacggcguaggggucgugccuaugcacacagacuuggagcuggauuucucacucccaaguagcucgaaguacacguauaaaagaaagcugaccuccccgauuaaccaagaacagucuguugaccuucauaucgagauagagagccagggaaucucaacaagugugcacgcccugggccauugguuugaugguagguugaaucucaaaacuuccuuccacuguuacggggcuugcaccaaguaugaauaccccuggcacacagcccggugucauuuugagcgagacuucgaauacgagaacucuuggggcugcaauccugcagauuguccaggaauuggcacugggugcaccgcgugcggaaucuauauugaccagcugaaacccgucgguagcgcuuacaaguuaaucacggugcgcuauuccagaaagguuugugugcaauuuggcgaagagaaccugugcaaaaccauagacaugaacgauuguuucguaacaaggcacgucaaggugugcauuaucgggacugugucaaaauuuagccagggagacacccuagucuuccucggcccuauggagggugggggccugauuuuuaaggauugguguacaaguacuugccaguucggagacccaggcgauaucaugucucccaaagacaagggguuuuccuguccggaguucaccggacauuuucggaaaaagugcaauuucgccacgacaccuguuugugaguacgauggcaacauggugagcgguuauaagaaaguaauggcaaccauagacucguuccaggccuuuaauacuucaucuauccacuacacagaugaacgcauugaguggaaggacccagaugggaugcuuaaagaccauuugaacauccuggugaccaaggauauugacuucgaaaaucucggagacaaccccugcaaagucggccugcaaacugugaguaucgagggugcuuggggcuccgggguuggauuuaccuuaacaugucaggugagccugacggagugcucuagauuccuuaccagcauaaaggccugcgauaaggcaauuuguuauggcgcucaguccucaacuuugaucagggggcaaaauacagucaaagugaguggaaagggcggucacagcgggucuuccuuuaaaugcugucacggaaccgacugcucacagcagggccuccaggccagugcgccucaucuggauaagaucaacgguauuguugaacaagagaaugaaaaaguguacgacgauggcgcuccccagugugggaucagcugcugguucgucaaguccggagaguggauucagggcauauuuaacgggaauuggaucguaauugugguucuaaucuucuuuuucauucugucucucauccugcuuucgauauuuuguccaauccguaagcacaaacggagcuga

SEQ ID NO: 10023 - RNA, 3402 nt, Artificial Sequence
  derived and/or modified CDS sequence (opt3) from DOBV(Ap1584/Sochi-01)__EU188450.1__GP
auguggggccugcuccuuaccaugauccugauugacuucggggccacauugagaaacguguacgauaugaggauagagugcccccacagcgucaauuuuggagaauccucuguuucagguaagguggaguuaccuccaguacugcuaagugaaguggagacucucgucccggaaagcuccuguaacauggacaaucaucagucuaugucgaucauucaaaaagugacgcagcugaccuggcggaagaaagcugauaaggcacaggccgcgaaagacucauucgagaucacaagcggcgagguuagucuuaaggggacuugcacccugacacaccgcaugguggaagauucccaucgaaaccguaagucuauuaucuguuaugacuugagcugcaauuccacccacuguaaacccacuaugcauaugauagucccuauccacucaugcaacaugaugaagaguugucucgugggacugggcccauacaggauucagguaguuuaugagagaacauacugcaccacggguauccugacugaagggaaauguuuugugcccgaucaaagcauugucaaugugaucaagaacggaguguucgacauagcuucugucuccauuguuugcuuuuucgugcggguaaaaggcaccaauuauaagaucauggccucaauuaagacagcaacuagcaacaauuguaacgauaccggcaauaaagugcagggguacuaucucugcaucgucggagguaacaguucuccuguguacguuccauccacaaccgacuuucgcagcauggaggccuuagcuucgaugcugagagcaccccacggcgaggaucaugaccuugccggggaagagguggcuacguacucuaucgccggacaggucgaaggcaaggugccucacacugcgaaugcagccaacauguugcugacagcuuucuccgguguaccaucauauaguagccuauccguuuuuaccgggucucaggauggaccgauuguguacagccccggccucuucccuaaacugaaccaaucaaguugcgacaaggucggccuuccacugauaugggagggguauaucgacuugcccggauacuaugaaacugugcaucaguguaaugucuuuugcgugcucuccgguccuggcgccagcugugaggcauucucugaagggggaauuuuuaacaucacaucaccaaauugcaugguuaguaaacagaacagguuccgggcugccgaacagcaagugaauuucgcgugucagagcguagaucaggacauacugaucuuuugcaacggccaaaagaaaaccauuuuaacgaagacccuggucaucggucaguguauuuaccccaucacaucccucuucucuauuaugccggggguggcccacucgauagcaaucgagcuuugcguuccuggcuuucacggaugggcuacugccgcucuguugaccacauucuguuuuggcugggugcuaauucccagcaucacucuggccguccucgugguacugaaguucuuugcagccauccuucauaauuccucacaggaaaaccgcuucaaacugauuuugaagaaaauaaaggaggaauuugagaaaaccaaggggaguauggugugcgagguuuguaaguaugaaugcgagacaggaaaagaacucaaggcucacaaucugucuugcccacagagccaauguccuuacugcuucacccauugugagcccacugaauccgcguuucaggcacacuacaaagucugccaggccacgcaucgauucagagaugacuuaaagaaaacaaucaccccacagucaacuagccccgguuguuauaggacccugaaccuauuucgguacaagucucguugcuauauuuucacagugugggugguccuccugguuguggaguccgugaugugggcugccagugcaagcgagaccguacuugaaccuucuuggaaugauaacgcccacggcgucggggugguuccaaugcacacugacuuggagcuggauuucucccucccgucaaguagcaaguacacauauaaacgcaagcugacgucgcccaucaaucaagaacaguccguggaccuucauauugagaucgagucucagggaauaagcaccucaguccacgcucugggccauugguuugaugguagauugaaccucaaaacuuccuuccacuguuacggggccugcacaaaguaugaauacccuuggcacaccgcaaggugucauuuugagcgggacuucgaauacgagaauaguuggggcugcaacccagcggauugucccggaaucggcacagggugcacugcuugcggaauuuauaucgaccagcugaaaccuguggguucugccuacaaguuaauuaccguucgauauagccgcaagguguguguacaauuuggcgaagagaaccugugcaaaacgaucgacaugaaugauuguuucgucaccagacacgugaaggugugcauaauugggacagucuccaaauuuucacagggagacacucuaguuuuccucggcccaauggagggugggggccugaucuuuaaggauugguguaccagcacaugccaguucggagaccccggcgauauuaugaguccgaaagacaagggguuuucuuguccugaguucacuggacauuuuaggaaaaagugcaacuucgcaaccacgccagugugugaguacgauggcaauaugguauccgguuauaagaaagugauggccacaaucgacagcuuccaggcuuuuaacaccucgucaauacacuacacugaugaacggaucgaguggaaggaccccgaugggaugcuuaaagaccauuugaauauucuggucacaaaggauaucgacuucgaaaaccucggagacucuccuugcaaagugggccugcaaaccguuaguauugagggugccuggggcuccggggugggauuuacuuuaaccugucaggucagccugacagagugcucucgcuuccuuacgagcaucaaggcaugcgauaaggcuauauguuauggcgcccaguccucaaccuugauuagagggcaaaauacugugaaaguuaguggaaagggcggucacagcgggucuuccuuuaaaugcugucacggaacagacugcucacagcagggccuccaggcgagugcuccccaucuggauaagaucaacgguaucguggaacaagagaaugaaaaagucuacgacgauggcgccccacagugugggauuagcugcugguucguaaaguccggagaguggauccagggcauuuuuaacgggaauuggauagugaucguugugcuaauuuucuuuuucauccugucucucauucugcuuucgaucuuuuguccuauaaggaagcacaaacguagcuga

SEQ ID NO: 10024 - RNA, 3408 nt, Artificial Sequence
  derived and/or modified CDS sequence (opt3) from DOBV(GER/05/477/Af)__GQ205411.1__GP
augaucauguggggccugcuccuuacccugagcuugauuaacuuaggggccucccugagaaauguguacgacaugaagauagagugcccccacucuaucaacuucggagaaucaagugucacagguaaaguugagcuaccuccacuccugcuuacugaugccgaagcacuggugccggagagcuccuguaauauggacaaccaucagucuuugucgauuacgcaaaagguaaccaaagugucauggaggaagaaagccgauaagguccaggcggcuaaggacagcuuugaaacaaccaguuccgaggugaauuucaaagggaccugcacacucacccaccggaugguugaggaaucuuaucgcaaccgaaagagcgugaucuguuacgaucuguccugcaauucaacucauuguaaacccacaaugcacaugauugucccugugcauaguugcaacaugaugaaaagcugucugguagggcucggaccauaucguauccagguuguguacgagagaaccuauugcacgacuggcauauuaaccgaagguaaauguuuuguccccgaccagucuaucauuuccgugcugaagaaugggguguucgauaucgccucagucagcauuguuugcuuuuucaucaggauaaagggaacaaguuacaaaauuaugacuucuaucaaggaggcaaacccuaauaacuguaaugacaccgauaacaaagugcaaggcuauuaccuuugcauuguaggcgccaauuccagcccaguguacgcucccucgacaaccgacuuucggucugucgaggcauuggccucccugcuacgcucaccucacggggaagaucacgaccucgcuggagaggaaguggccacguauaguaucgcgggucagguugagggcaaggugccacauacugcaaacgccgcuaacaugcuguucacagccuuuagcgggaucccguccuacucuagcuucucagucuuuaccggaaaucaggaaggcaacgugauuuauagucccggucuuuucccuaaacugaaucaguccagcugcgagaagguagcauugccacucauaugggagggguacaucgaucugcccggauauuacgaaacuguucacccuuguaacguguuuugcgucuuaucuggcccaggcgcuucaugugaggccuucagugaagggggaauuuucaauaucacaagccccacuugccugguguccaaacaaaacagauuuagggcggccgagcagcagauaaauuucgucugucagcggguggaccaagacauuguuaucuauugcaacggucagaagaagacgauccucaccaaaacacuugugauuggccaguguaucuacucuguaacuucgcuguuuagcauuaugccgggggucgcacauuccauagcuaucgaauugugcgugccuggauuccacggcugggccaccgcugcccuacugacaacuuuuuguuucgguuggauucucauccccucaaucacccuggcaauucuuauaauccugaaguuuuucgccgcuuuguuucacaauaguucucaagagaaccgcuucaaaauuauccucaagaaaauuaaggaggaauuugagaagacaaaagggagcaugguuugcgaaguguguaaguacgagugcgaaaccggcaaagagcugaaggcgcauaauuuauccugcccacagucacaguguccuuauugcuucacucacugugagcugacggaaagcgcauuucaggcccauuaccgagucugccaagcuacacacagauucagggaugaccuaaagaagaccaucacuccccagucuaccuccccaggauguuaucggacacucaaccuguuccguuacaagagucgcugcuauauauuuaccguguggguaauccuuuugauuaucgagagcauucugugggccgcaucugccuccgaaacugugcucgagcccucauggaaugauaacgcucauggcguuggggucgugccuaugcacacagaccuggagcuugauuucagucugccaagcucguccaaauacacguauaagagaaaauugaccucuccgaucaaucaggaacagagcguggaccuccacauagagauugaaucacaaggaaucaguacuuccguccaugcccugggucacugguuugauggcagguuaaaccugaagacaucuuuccauuguuacggggcaugcaccaaauacgaguaucccuggcacacagcgaagugucacuuugaacgggacuucgaguacgagaacagcugguccugcaauccugcugauuguccaggaauuggcacugguugcaccgccugcgggcuauaucucgaccagcugaagcccguuggcucagcauacaaacuuaucacggugcgauauagccgcaagguguguguacaguuuggagaagagaacuugugcaaaaccauagauaugaaugacuguuucgucacaagacaugugaagguuugcaucauuggcacugugaguaaauuuucucagggggacacccuggucuuccucggaccuauggaagguggcgggcugaucuuuaaggauugguguacaacuaccugccaauucggagacccaggcgauauuaugucccccaaagacaaggguuuuagcuguccggauuucacggggcacuucaggaagaaaugcaacuuugccacaaccccugugugugaguacgacggcaauaugguuucgggauauaagaaagugauggcuacuaucgauucauuccaggccuuuaacacaucuaauauacauuacaccgacgaacggauugaguggaaggauccagacggcauguuaaaagaucaccugaacauccuuguaacuaaggacaucgauuucgagaauuugggggaaaaccccugcaaggucggacuccagaccgcaaguauugacggcgcuugggguuccggggugggauuuacacugacgugucagaucagccuaaccgagugcucucgcuuccugacuagcauuaaagccugcgacauggcgauauguuacggcgcccaauccgugacacucgucagaggucagaauaccguuagggugucaggcaagggcggacauaguggcagcucuuuuaaaugcugucacgggacagauugcucccagcaaggacugcaggcuucagcaccucaccuugacaagguaaacggcaucguggaacaggagaguacucaggucuaugaugacggugcuccccaaugugggauuagcugcugguucgugaaauccggagaauggaucaagggcauuuuuaaugguaacuggaucguuauaguggucuugaucuuccuguuuuuacucucucugauucuucugucguucuuguguccaauccguaagcauaaacggagcuga

SEQ ID NO: 10025 - RNA, 3408 nt, Artificial Sequence
  derived and/or modified CDS sequence (opt3) from DOBV(GER/07/607/Af)__GQ205410.1__GP
augaucauguggggccugcucgugacccuuagccugauuaacuugggggccuccuuaagaaaugucuacgacaugaagauagagugcccccacucuaucaacuucggagaaucaaguguuacagguaaaguggagcugccuccacuaccgcucacugaugcugaaacgcugguacccgagagcuccuguaauauggacaaccaucagucucuuucgauuacccaaaaggugacaaaagucucauggaggaagaaagcagauaaggugcaggccgcgaaggacagcuuugaaacuaccaguuccgagaugaaucugaaaggcacaugcaccuugacucaccggaugguugaggaaucuuaucgcaaccgaaagagcgugaucuguuacgaucucuccugcaauucaacacauuguaaaccuaccaugcacaugauugucccagugcauaguugcaacaugaugaagucgugucugguagggcugggacccuaucguauccagguuguguacgagagaacguauugcacuaccggcauacucacagaagguaaauguuucgucccugaccagucuaucauuuccgugaugaagaaugggguguuugauaucgcuucagucagcauuguuugcuucuuuaucaggauaaagggaacgaguuacaaaauuaugaccucuaucaaggaggccaacccaaauaacuguaaugacacagauaccaaagugcaaggcuauuacuuaugcauuguaggcgcaaacuccagccccguguacgccccuucgacgacugacuuccggucugucgaggcucuggcaucccuuuugcgcucaccacacggggaagaucacgaccuggccggagaggaaguggcuacauauaguaucgccggucagguugagggcaaggugccgcauaccgcgaaugcagccaacaugcuauuuacugcuuucagcgggauccccuccuacucuagcuuuucagucuucacaggaaaccaggauggcaccgugauuuauaguccuggucucuuuccaaaacugaaucaguccagcugcgacaagguagcccuuccccugauaugggaaggguacaucgacuugccuggauauuacgagacgguucacccauguaacguguucugcguccucucuggccccggcgcaucaugugaggcuuuuagugaagggggaauuuucaauaucaccagcccgacaugccugguguccaaacaaaacagauucagggccgcggagcagcagauaaauuuugucugucagcggguggaucaagacauuguuaucuauugcaacggucagaagaagacuaucuuaaccaaaacacuggugauuggccaguguaucuacucuguaacuagccucuucagcauuaugccuggggucgcccauuccauagcaaucgaacuuugcgugcccggauuucacggcugggcuaccgccgcucuguugacaaccuucuguuuugguuggauucuaaucccaucaaucacucuggccauucucauaguucugaaguucuuugcagcccuucugcacaauaguucucaagagaaccgcuucaaaaucauuuugaagaaaaucaaggaagaguuugagaagacgaaagggagcauggugugcgaagucuguaaguacgagugcgaaacaggcaaagagcucaaggcucauaaucuguccugcccucagucacagugucccuauugcuucacccacugugaauuaacugagagcgcguuucaggcacauuaccgagugugccaagccacccacagauucagggaugaccugaaaaagacaauuaccccacagucuacuucccccggauguuaucggacacuaaaccucuuucguuacaagagucgcugcuauaucuucacgguaugggugauacugcuuaucauugagagcaucuugugggcugccucugcauccgaaaccguucuggagccuucauggaaugauaacgcccauggcgucgggguggugccaaugcacgcugaccucgaacuggauuucagucuuccgagcucguccaaauacacuuauaagagaaaacugacaucucccauuaaucaggagcagagcgucgacuugcacaucgagauagaaucacaaggaauuaguaccuccguucaugcccucggucacugguuugauggcaggcugaacuuaaagacaucuuuccauuguuacggggcaugcacuaaauacgaguauccuuggcacaccgcgaagugucacuuugaacgggacuucgaguacgaaaauagcugguccugcaacccagcugauugucccggaaucggcacggguugcaccgccugcgggcuguaucuagaccagcucaagccugugggcucagcauacaaacugauuacagugcgauauagccgcaagguauguguccaguuuggagaggagaaccuuugcaaaacuaucgacaugaaugauuguuucgugaccagacauguuaaggugugcauaaucggcacagucaguaaauuuucucagggggacacuuugguguuccugggaccaauggaagguggcgggcucauuuuuaaggauugguguaccacgacaugccaauucggagaccccggcgauaucauguccccgaaagacaaggguuuuagcuguccugauuucaccgggcacuuuaggaagaaaugcaacuucgccacuacaccaguuugugaguacgacggcaauauggugucgggauauaagaaaguaauggcuaccauugauucauuccaggccuuuaacacuucuaauauccauuacaccgacgaacggauagaguggaaggaucccgacggcaugcugaaagaucacuuaaacauucuggucacaaaggacaucgacuucgaaaaucuuggggagaacccuugcaaggugggauugcagacggcaaguaucgauggcgcuugggguuccggggugggauuuacccucacuugucagauuagccugacagagugcucucgcuuccuaaccagcaucaaagccugcgacauggcgauuuguuacggcgcccaauccgucacacugguuagaggucagaauacugugaagguaucaggcaaagggggacauaguggcagcucuuuuaagugcugucacgggaccgauugcucccagcaaggacuccaggcuucagcaccccaccuggacaaagugaacggcauagucgaacaggagaguacucagguguaugaugacggugccccacaaugugggaucagcugcugguucguuaaguccggagaauggauuaagggcaucuuuucugguaauuggauugugaucgucgugcuuauauucuuguuucuguuaucgcucauccugcuuagcuuccuguguccuauuaggaaacauaagcguucauga

SEQ ID NO: 10026 - RNA, 3408 nt, Artificial Sequence
  derived and/or modified CDS sequence (opt3) from DOBV(GER/08/118/Aa)__GQ205412.1__GP
augaucauguggggccugcucgugauucuuagccugauaaacuugggggccuccuuaagaaaugucuacgacaugaagaucgagugcccccacucuauuaacuucggagaaucaaguguuaccgguaaaguggagcugccuccacuaccgcucacagaugcugaaacucugguacccgagagcuccuguaauauggacaaccaucagucucuuucgaucacgcaaaaggugaccaaagucucauggaggaagaaagcagauaaggugcaggccgcgaaggacagcuuugaaacaacuagcuccgagauuaaucugaaagggaccugcacauugacccaccggaugguugaggaaucuuaucgcaaccgaaagagcgugaucuguuacgaucucuccugcaauucaacucauuguaaaccuacaaugcacaugauagucccagugcauaguugcaacaugaugaagaguugucugguagggcugggacccuaucguauccagguuguguacgagagaaccuauugcacgacuggcauucucaccgaagguaaauguuucgucccugaccagucuaucauuuccgugaugaagaaugggguguuugauaucgcuucagucagcauaguuugcuucuuuauuaggaucaagggaacaaguuacaaaauuaugacuucuaucaaggaggccaacccaaauaacuguaaugacaccgauaacaaagugcaaggcuauuacuuaugcaucguaggcgcaaauuccagccccguguacgccccuucgacaaccgacuuccggucugucgaggcucuggcaucccuuuugcgcucaccacacggggaagaucacgaccuggccggagaggaaguggcuacguauaguauugccggucagguugauggcaaggugccgcauacugcgaacgcagccaacaugcuauuuacagcuuucagcgggauacccuccuacucuagcuuuucagucuucaccggaaaucaggacggcacugugaucuauaguccuggucucuuuccaaaacugaaccaguccagcugcgacaagguagcccuuccccugauuugggagggguacaucgauuugccuggauauuacgaaacaguucacccauguaauguguucugcguccucucuggccccggcgcaucaugugaggcuuuuagugagggcggaauauucaacauuaccagcccgacgugccugguguccaaacaaaauagauucagggccgcggaacagcagaucaacuuugucugucagcggguggaccaagauaucguuauuuauugcaauggucagaagaagaccaucuuaacaaaaacucuggugauuggccaguguauauacucuguaaccucgcucuuuagcaucaugccuggggucgcccauuccauugcaaucgagcuuugcgugcccggauuucacggcugggcuacagccgcucuguugacuaccuucuguuuugguuggauccuaauuccaucaauaacacuggccauccucauuguucugaaguucuuugcagcccuucugcacaacaguucucaagaaaaucgcuucaaaaucauuuugaagaaaaucaaggaggaauuugagaagaccaaagggagcauggugugcgaggucuguaaguacgaaugcgagacuggcaaagaacucaaggcucauaaccuguccugcccucagucacagugucccuauugcuucacgcacugugaguuaacagaaagcgcguuucaggcacauuaccgagugugccaagccacccacagauucagggacgaucugaaaaagacuauaaccccacagucuacaucccccggauguuaucggacccuaaaucucuuucguuacaagagucgcugcuauaucuucacuguaugggugauucugcuuaucauugagagcaucuugugggcugccucugcauccgagacaauacuggaaccuucauggaacgacaaugcccauggcguuggggucgugccaaugcacacggaucucgagcuggacuucagucuuccgagcucguccaaauacaccuauaagagaaaacugacuucucccauuaaccaggaacagagcguggauuugcacaucgagauugagucacaaggaaucaguacauccguccaugcucucggucacugguuugacggcaggcugaauuuaaagaccucuuuccauuguuacggggccugcacaaaauacgaauauccuuggcacacugcaaagugucacuuugagcgggauuucgaauacgagaacagcugguccugcaacccagcggacugucccggaauaggcaccgguugcacggcuugcgggcuguaucuagaccagcucaagccuguuggcucagccuacaaacugaucaccgugcgauauagccgcaagguguguguacaguuuggagaagagaaucuuugcaaaacaauugauaugaacgacuguuucgucacuagacaugugaagguuugcaucauuggcaccgugaguaaauuuucucagggggauacauuggucuuccugggaccaauggaggguggcgggcucaucuuuaaggacugguguacuaccacgugccaauucggagaucccggcgacauaauguccccgaaagauaaggguuuuagcuguccugacuucacagggcacuuuaggaagaaaugcaauuucgcaaccacuccagugugugaauacgauggcaacaugguuucgggauauaagaaagugauggccacaauugacucauuccaggcuuuuaauaccucuaacauccauuacacugaugagcggaucgaaugggaggaccccgauggcaugcugaaggaccacuuaaauauucugguaaccaaagacaucgauuucgaaaaccuuggggagaauccuugcaaggucggauugcagacagccaguauugacggcgcaugggguuccggggugggauuuacgcucaccugucagauaagccugacugagugcucucgcuuccuaacaagcaucaaggcuugcgauauggccauuuguuacggcgcgcaauccgugacccuggucagaggucagaacacaguuaaagugucaggcaaagggggacauaguggcagcucuuuuaagugcugucacgggacugacugcucccagcaaggacuccaggccucagcuccccaccuggauaagguaaauggcaucguggaacaggagaguacccaggucuaugacgauggugcaccacaaugugggauuagcugcugguucgugaaauccggagaauggaucaagggcguuuucucugguaacuggauagugaucgucgugcuuauuuucuuguuucuguuaucgcucauccugcuuagcuuccuguguccuauuaggaagcauaaacguucauga

SEQ ID NO: 10027 - RNA, 3408 nt, Artificial Sequence
  derived and/or modified CDS sequence (opt3) from DOBV(GER/08/131/Af)__GQ205413.1__GP
augaucauguggggccugcuccuuacccugagcuugauuaacuuaggggccucccugagaaauguguacgacaugaagauagagugcccccacucuaucaacuucggagaaucaagugucacagguaaaguugagcuaccuccacuccugcuuacugaugcugaaacgcuggugccggagagcuccuguaauauggacaaccaucagucuuugucgauuacccaaaagguaacaaaagugucauggaggaagaaagcagauaagguccaggccgcgaaggacagcuuugaaacuaccaguuccgaggugaaucucaaaggcacaugcacccugacucaccggaugguugaggaaucuuaucgcagccgaaaguccgugaucuguuacgaucugucaugcaacaguacacauuguaaacccaccaugcacaugauugucccugugcauagcugcaauaugaugaagucuugucucguaggguuaggaccauaucguauccagguuguguacgagagaacguauugcacuaccggcauacugacagaagguaaauguuucguccccgaccaguccaucauuucagugaucaagaacgggguguuugauauugcuagcgucaguaucguuugcuucuuuauaaggauuaagggaacuucuuacaaaaucaugaccuccauuaaggagagcaauccuaacaauuguaacgacacagauaauaaagugcaaggcuauuaccuuugcaucguaggcgccaacucgucuccaguguacgcacccuccaccacggacuuccggucagucgaggccuuggcuagucugcuacgcagcccuuauggggaagaucacgaccucgcaggagaggaaguggccacuuacuccaucgcuggucagguugagggcaaggugccacacacagccaaugcggcaaacaugcuguuuaccgccuucucugggauuccgagcuauucaaguuuuuccgucuucacuggaaaccaggauggcaaugugauauacagccccggucuuuuuccuaaacugaaccagucuucaugcgaaaagguagcuuugccacucaucugggagggguauauugaccugcccggauacuaugagacaguucauccuuguaauguguucugcgucuuaaguggcccaggcgccagcugugaagcauuuuccgaagggggaaucuucaacauaaccucucccacgugccuggugucgaaacaaaauagauucagggcugccgagcagcagauuaacuuugucugucagcggguggaccaagauaucguuaucuacugcaauggucagaagaagaccauucucacaaaaacucuugugaucggccaguguauuuacagcguaaccucccuguucucaauaaugccgggggucgcgcacaguaucgccauugaguugugcgugccuggauuucauggcugggcaacagcugcccuacugacuaccuucuguuuugguuggauccucauccccucuauuacacuggcuauacuuaucguucugaaguucuuugccgcauugcuccacaacagcucccaagaaaaucgcuucaaaauuauccugaagaaaauuaaggaggaguuugaaaagaccaaagggucaauggugugcgaggucuguaaguaugaaugcgagacuggcaaagaauuaaaggcccacaaccugagcugcccacagucucaguguccuuacugcuucacgcauugugagcuaacagaguccgcuuuucaggcgcacuaucgagugugccaagcaacccauagauucagggacgaucucaaaaagacuaucacaccccagaguaccagcccaggauguuaccggacccugaaucuuuuucguuauaagucucgcugcuacauauucacuguaugggugaucuugcugauuaucgaauccauucucugggccgcuucagccagugagaucguucuggaacccagcuggaacgacaaugcacacggcgucgggguggugccuaugcauacagaucuugagcuggacuucucguugccauccucuagcaaauauacguacaagagaaaacucaccucaccgauaaaccaggagcagagugucgaucugcacauugaaaucgagucccaaggaauuucuacuagcguucacgccuuaggucauugguuugacggcaggcugaaucuaaagacauccuuccacuguuacggggcuugcaccaaauaugaauaccccuggcauacagccaagugucacuuugagcgggauuucgaauaugagaacucauggagcugcaacccugcagacuguccaggaaucggcacugguugcaccgcgugcgggcucuaccuggaucagcuuaagcccgugggcagugcuuauaaauugauaacggugcgauacucucgcaagguauguguccaguuuggagaggaaaaucugugcaaaaccaucgacaugaacgacuguuucgugacaagacacguuaaggugugcauuaucggcacugucuccaaauuuagccagggggauacccucguguuccugggaccuauggaggguggcggguuaauuuuuaaggacugguguacaacuaccugccaauucggagauccaggcgacaucaugucgcccaaagauaaggguuuuucauguccggacuucacggggcauuuuaggaagaaaugcaauuucgccacaaccccuguuugugaauaugauggcaacauggugucuggauacaagaaaguaauggcaacuauagacaguuuccaggccuuuaauacauccaacauucacuacaccgaugagcggaucgaauggaaggacacugauggcaugcugaaagaccaucuuaauaucuuggucaccaaggauauugacuucgagaaccucggggagaauccaugcaaggugggacugcagacagcuagcaucgacggcgccugggguucuggggugggauuuacgcuaaccugucagauuagccugacugaaugcucccgcuuccucacaucaauaaaagcaugcgauauggcuaucuguuauggcgcccaaagugucacccugguuagaggucagaacacagugaggguaagcggcaaagggggacacucuggcuccucauuuaagugcugucaugggacugacugcagucaccagggacuucaagcgagcgcuccccacuuggauaaggugaauggcauugucgagcaggaauccacccagguguacgacgauggugccccucagugugggaucucuugcugguucguuaaaucgggagaguggauuaagggcaucuuuagcgguaacuggauagugaucgucgugcugauuuucuuauuucuccugucacuuauccuguuguccuuccucugucccauucguaagcauaaacggaguuga

SEQ ID NO: 10028 - RNA, 3408 nt, Artificial Sequence
  derived and/or modified CDS sequence (opt3) from DOBV(GRW/Aa)__JQ026205.1__GP
augaucauguggggccugcuccuuacccugagcuugauuaacuuaggggccucccugagaaauguguacgacaugaagauagagugcccccacucuaucaacuucggagaaucaagugucacagguaaaggcgagcuaccuccacuccugcuuacugaugcugaaacgcugguuccggagagcuccuguaauauggacaaccaucagucuuugucgauuacccaaaaggugacaaaaguaucauggaggaagaaagcagauaaggugcaggccgcgaaggacagcuuugaaacuaccaguuccgaggucaaucucaaagggacaugcacccugacucaccggaugguggaggaaucuuaucgcagccgaaaguccguuaucuguuacgaucugucaugcaacaguacacauuguaaacccaccaugcacaugauugugccuguccauagcugcaauaugaugaagucuugucucgugggauuaggcccauaucguauccagguaguuuacgagagaacguauugcacuaccgguauacugacagaagggaaauguuucgugcccgaccaguccaucauuucagucaucaagaacggaguguuugauauugcuagcgugaguaucgucugcuucuuuauaaggauuaagggcacuucuuacaaaaucaugaccuccauuaaggagagcaauccuaacaauuguaacgacacagauaauaaaguucaaggcuauuaccuuugcaucgugggggccaacucgucuccaguauacgcacccuccaccacggacuuccggucaguggaggccuuggcuagucugcuacgcagcccuuauggagaagaucacgaccucgcaggagaggaagucgccacuuacuccaucgcuggccagguggaggggaagguuccacacacagccaaugcggcaaacaugcuguuuaccgccuucucugguauuccgagcuauucaaguuuuuccguguucacuggcaaccaggaugguaaugucauauacagccccgggcuuuuuccuaaacugaaccagucuucaugcgaaaagguggcuuugccacucaucugggagggauauauugaccugcccggcuacuaugagacaguacauccuuguaauguuuucugcgugaguagcggcccaggggccuccugugaagcauuuucugagggagguaucuucaacauaaccucgcccacgugcuuagucagcaaacaaaauagauucagggcugccgaacagcagauuaacuuugugugucagcgggucgaccaagauaucgugaucuacugcaauggccagaagaagaccauucugacaaaaacucucguuaucgggcaguguauuuacuccgugaccucacuuuucaguauaaugccgggaguagcgcacucuaucgccauugagcugugcgucccuggcuuucaugguugggcaacagcugccuugcuaacuaccuucuguuuuggguggauccugauccccagcauuacacucgcuauacugaucgugcuuaaguucuuugccgcacuguugcacaacuccucacaagaaaaucgcuucaaaauuauccucaagaaaauuaaggaggaguuugaaaagaccaaaggcagcaugguuugcgagguguguaaguaugaaugcgagacuggaaaagaacugaaggcccacaacuuaucuugcccacagucccaguguccuuacugcuucacgcauugugagcugacagagagugcuuuucaggcgcacuaucgagucugccaagcaacccauagauucagggacgaucucaaaaagacuaucacuccccagagcacaucuccaggcuguuaccggacccuaaaucuguuucguuauaagucccgcugcuacauauucacuguguggguaauccuuuugauuaucgaaucaauucugugggccgcuagugccagcgagaucgugcucgaacccucguggaacgacaaugcacacgggguuggagucgugccuaugcauacagaucuggagcuugacuucucccugccaucuagcucaaaauauacguacaagagaaaauugaccaguccgauaaaccaggagcaguccguggaucuccacauugaaaucgagucucaagguauuagcacuuccguccacgcccugggccauugguuugacgggagguuaaaucugaagacaucauuccacuguuacggagcuugcaccaaauaugaauaccccuggcauacagccaagugucacuuugagcgggauuucgaauaugagaacagcuggaguugcaacccugcagacuguccaggcaucgguacugggugcaccgcgugcggccuauaccucgaucagcugaagcccguuggaucugcuuauaaacuuauaacggugcgauacucccgcaagguguguguacaguuuggcgaggaaaauuugugcaaaaccaucgacaugaacgacuguuucgucacaagacacgugaagguuugcauuaucgggacugugagcaaauuuucgcagggagauacccuggucuuccucgguccuauggagggcgggggacugauuuuuaaggacugguguacaacuaccugccaauucggcgauccaggugacaucaugucacccaaagauaagggguuuucuuguccggacuucacgggccauuuuaggaagaaaugcaauuucgccacaaccccugugugugaauaugauggaaacaugguuaguggcuacaagaaagugauggcaacuauagacuccuuccaggccuuuaauacaagcaacauucacuacaccgaugagcggaucgaauggaaggacccagaugggauguuaaaagaccaucugaauauccuuguaacuaaggauauugacuucgagaacuugggagagaaucccugcaaggucggccuccagaccgcuucuaucgacggugccugggggagcggagugggcuuuacacugacgugucagauuucccuaaccgaaugcucacgcuuccugaccaguauaaaagcaugcgauauggcuaucuguuauggugcccaaagcgugacacucgucagaggccagaacaccguuagggugucugggaagggaggccacuccgggucaaguuuuaaaugcugucauggaacagacugcagccaccagggccugcaagcguccgccccucaccuugauaagguaaaugguauuguggagcaggaaucuacucaggucuacgacgauggggcuccccaguguggaaucucgugcugguucauuaaaagcggcgaguggaucaaggguauauuuucaggcaacuggaucgugauuguuguguugaucuuccuguuuuuacucucccugauucuucugaguuucuuguguccaauccguaagcauaaacggucuuga

SEQ ID NO: 10029 - RNA, 3408 nt, Artificial Sequence
  derived and/or modified CDS sequence (opt3) from DOBV(Slo/Af-BER)__GU904035.1__GP
augaucauguggggccugcuccuuaccaugauucugauagacuucggggccagcuugagaaacguguacgauaugaagaucgagugcccccacuccauuaauuuuggagaaucuucagucacagguaaaguugaguuaccuccacugcuacucacugacgcugaagcacuggugccggagaguagcuguaacauggauaaucaucaguccaugucuaucauucaaaagguaacgaaagugucguggaggaagaaagccgacaaggcgcaggcugccaaggauucauucgaaaccacaagcagugaggucaaccuuaaaggcacuugcacccugucccaccggaugguggaggaaucuuaucgcaaucgacguagcguuaucuguuacgacuuguccugcaacucaacacauuguaagcccaccaugcacaugauagugccuguccauaguugcaauaugaugaaaagcugucucguggggcugggaccauauagaauccagguaguuuacgagaggacuuauugcacaaccggcauucugacggaagguaaguguuuugugcccgaucagucuaucgucuccgugauuaaaaacgggguguucgacaucgcaucagucagcauaguuugcuuuuucauucgggugaagggaacuaauuacaagaucauggccaguauuaaaaccgcuacagcaaacaauuguaacgauacugacaauaagguacaaggcuauuaccucugcaucgugggcgggaacucuuccccugucuacgccccaagcaccacagauuuucgcucgauggaggcuuuagccucucugcuuagagcgccccacggagaggaccacgauuuguccggugaagagguggcaaccuauucaaucgccggccagauugaagggaaaauaccucauacggcuaaugccgcaaacaugcuguucacugcuuuuaguggaaucccaagcuacuccucucuaagcguuuucauuggcucacaggacgguccgaucauauauagucccgggcucuuuccuaagcugaaccaguccagcugcgacaaaguggcccuuccacugauuugggagggauacaucgauuugcccggcuauuacgaaacaguccacccuuguaauguguucugcguacucucuggcccaggggcgucaugugaggccuuuagugagggagguaucuucaacauuaccagccccacuugccugguuuccaagcaaaauagguuccgggcagcugaacaacaggugaacuuugucugucagcgcguggaccaggauaucauuauauauugcaauggccagaaaaagacaaucuuaaccaagacgcuggucauugggcaguguaucuacucugugaccagccucuucucgaucaugccgggaguugcccauuccauugcuauagagcuuugcgugccuggcuuucacgguugggccacagcagcccuguugacuaccuucuguuuuggguggauccuaauucccucaaucacacuggcuguacucgucgugcugaaauucuuugcggcaauucuucacaacaguucucaagaaaaucgauucaagaucauacugagaaaaaucaaggaggaauuugagaaaacuaagggcagcaugguuugcgagguguguaaguacgaaugcgagaccggaaaagaauugaaggcccauaaccucuccugcccacagucacaguguccuuauugcuucacacacugugagcccaccgaaagcgcuuuucaggcccauuacaaagucugccaagcaacucacagguuccgggacgaucugaagaaaacgauuacaccacagucuaccucccccggcuguuaucguacuuuaaaucuguuucgcuacaagaguagaugcuauaucuucaccguguggguaacacuacucauuaucgagagcauaaugugggccgcuucugccuccgagaacgugcuggaaccuucauggaaugacaacgcacaugggguuggagucgugccaaugcacaccgaucuugaguuggacuucagucugccgagcucguccaaguacacuuauaaaaggaagcucacaucuccccugaaucaggaacagagcguggaucuucacauugagaucgagucacaagguauuaguacguccguccaugcgcugggccacugguuugacgggcgguugaaccucaaaaccucuuuccauuguuacggagcuugcacuaaguacgaauauccuuggcacacagccaaaugucacuuugagcgagauuucgaauacgagaauagcuggggcugcaacccagcagacugucccgguaucgggaccggcugcacagccugcggacuguauauagaccaguuaaagccuguuggcuccgcuuacaagcugaucacugugcgcuauucaagaaaaguguguguacaguuuggggaagagaaccuaugcaagaccauugauaugaaugacuguuucgucacgaggcaugugaaaguuugcaucauuggaaccgugagcaaguuuagucagggugauacacucgucuuccugggcccaauggaagggggaggccuuaucuuuaaagacugguguacuucuaccugccaauucggugaucccggggacauaauguccccgaaggauaaaggcuuuagcuguccugacuucacaggacacuuucggaagaagugcaacuucgccacuaccccagugugugaguacgauggcaauaugguuucgggguauaaaaaggugauggcaacgauugacucauuccagucuuuuaacacaaguuccauccauuacaccgaugagcgcaucgaauggaaagaccccgauggaauguugaaggaccaccugaauauucucguaacuaaagacaucgauuucgagaaccugggcgaaaauccuugcaaggucgguuuacagacaagcucuauugagggggcuuggggaagcggcguggguuuuacccugacuugucagauaucccuuaccgagugcucaagauucuugacaaguaucaaggccugcgacauggcgauuuguuacggcgcccaaagcgugacgcucaucagggggcagaacaccgucaaaguuucuggaaagggcgggcauuccggaucaaguuuuaaaugcugucacggcacugauugcagccagcaaggucugcaggcuuccgcaccccaccuagacaaggugaaugggauuguagaacaggauucugagaaaguguaugacgauggagccccacaguguggcaucucgugcugguucgucaagagcggugaauggauaacaggcaucuuuaacgggaauuggauugugaucguugugcuggucuucuuuuucauucucucacugauccuuuugucccuguuauguccuauacguaagcauaaacggaguuga

SEQ ID NO: 10030 - RNA, 3408 nt, Artificial Sequence
  derived and/or modified CDS sequence (opt3) from HTNV(76-118/POR)__KT885048.1__GP
augggcaucuggaaguggcuggugauggccagccucgucuggcccguucuuacccugagaaacguguacgacaugaagauugagugcccucacacaguauccuucgggggaaauucugugauagguuaugucgaauugccaccggugcccuuagcugauacugcacagaugguuccugagucaaguuguagcauggacaaccaucaaucccugaauacgaucaccaaguacacacaggugucuuggaggggcaaagccgaucagucgcagucaagccaaaacaguuuugaaacugucuccaccgagguggaccuaaaggggacaugcguacucaaacacaagaugguugaagagucuuaucggagccgcaaguccgugaccuguuacgaucugucaugcaauaguacuuauuguaaaccaacacuuuacaugauuguccccauccaugcgugcaacaugaugaaaagcugucugauugcuuugggaccuuaucgaguccaggugguguacgagcguaccuacugcaugacgggcguucucaucgaagguaaauguuucgugccagaccagucuguaguguccauaaucaagcacgggauuuuugauaucgccucaguccauauugugugcuucuuuguugcagugaaaggaaauacuuauaagaucuucgagcaggucaagaaaaguuuugaaagcaccuguaacgacacagagaauaaggugcaaggcuacuauauaugcauuguaggcgggaacucugcccccaucuacguuccuacucuggaugacuucagauccauggaggcuuuuaccggaauuuucaggagcccacacggugaagaucacgaccuggcaggcgaggaaaucgccucguauucuaucguggggccggcuaaugccaaagucccccauuccgcgucaagugauacacuccgguuaauugcauacagcggaauaccuuccuauucuagccugucaauccuuaccaguuccacggaggccaagcacguguuuagcccaggcuuguuccccaaacugaaccauacuaauugcgacaagucugcuauuccucuaaucuggacagguaugauagaccucccaggguacuacgaagccguccaccccuguaccguguuuugcguucugucaggaccgggcgcaaguugugaggcuuucagcgagggcgggauuuucaacaucacuuccucuaugugccuugugucgaaacagaaucgcuuuagacugacagaacagcagguaaacuucgucugucaaaggguggauauggacaucguuguguauugcaacggacagcggaaggucauuuugaccaagacgcucgugaucggucaguguauuuacaccauaacaagccuguuuuccuuacugccuggcguagcccacucaaucgcgguggagcucugcguucccggguuccauggaugggccacugcagcccuucuggucaccuuuuguuucggcuggguguugauuccagcuaucacauuuaucauucuaacugugcugaaauucauagcuaauaucuuucacaccaguaaccaagaaaaucgccucaagucuguccugcgaaaaauuaaggaggaauuugagaaaacaaaggguagcaugguuugcgauguguguaaguaugagugcgaaaccuacaaagagcuuaaggcccaugggguguccugcccucagucacagugucccuauugcuucacucacugugaaccaacggaggcagccuuccaggcucauuacaaaguaugccaagucacacacagauuuagggacgaucugaagaaaaccgugacuccccagaacuucaccccuggcuguuaucggacauugaaucucuuccguuacaagagccgcugcuacaucuuuaccauguggauuuuccuguuaguucuggaaucuauccuaugggcggcauccgccagugagacuccacucacaccgguguggaacgacaaugcucacggagucggcagcgugcccaugcauacggaucuggagcuugacuuuucuuugaccuccucaaguaaguauacuuacagaaggaaacugacaaacccucucgaagaggcccagagcauagaucugcacaucgaaauugaggagcagaccaucgggguugacgugcaugcacuuggacacugguucgauggucggcugaauuugaagacaucguuucacuguuauggcgccugcacuaaauacgaauauccauggcauaccgcuaagugucacuacgagcgagacuaucaauacgaaacguccugggggugcaaccccucugacuguccuggaguaggcaccgguugcacagccugcgggcucuaccuggaucaguuaaaaccagucggcagcgcauauaagauuaucacuauacgcuacucaagaagggugugugugcaguucggagaggaaaaucugugcaagauuaucgacaugaacgauuguuuugucagucggcauguuaaagugugcauuaucggcaccguauccaaguucucucagggggacacacuacucuuuuucggaccccuggaggguggcgggcuuauauuuaaacacugguguacuagcacgugccaauucggagauccgggcgacaucauguccccucgcgauaagggguuuuuguguccagaguuccccgggucauucagaaagaagugcaauuuugcgaccacaccuauuugugaauaugacggcaacauggugagcggauacaaaaaggucauggcuaccaucgauaguuuccagucuuuuaauacuuccacaaugcauuucaccgacgagaggauugaauggaaggaucccgacggcaugcugcgugaucacaucaacauacucgugacuaaagacauugacuuugauaaccugggggagaauccaugcaagaucggauuacagaccagcucgaucgaaggcgccugggguucagggguuggauucacacugacgugucuugugucuuugaccgagugcccuacuuuucucacaaguauuaaagcaugcgacaaggccaucuguuauggcgcugaguccgucacccugacacggggucagaacacugugaaaguuagcggcaaggguggacacucuggcagcaccuucaagugcugucauggggaagauugcucccaaauuggacuacacgccgcagcuccccaucuggacaaagugaauggcauaucagagaucgaaaacaguaaggucuacgaugacggugccccacagugugggauuaaaugcugguuuguaaagagcggagaguggaucucuggcauuuucuccgguaauuggaucgugcucauaguucuguguguguuucuuuuguucucacuggucuuacucaguauccugugcccggugcgaaaacacaaaaagagcuga

SEQ ID NO: 10031 - RNA, 3408 nt, Artificial Sequence
  derived and/or modified CDS sequence (opt3) from HTNV(76-118)__Y00386.1__GP
augggcaucuggaaguggcuggugauggccagccucgucuggcccguucuuacccugagaaacguguacgacaugaaaauugagugcccucacacaguauccuucgggggaaauucugugauagguuaugucgaauugccaccggugcccuuagcugauacugcacagaugguuccugagucaaguuguagcauggacaaccaucaaucccugaauacgaucaccaaguacacacaggugucuuggaggggcaaagccgaucagucgcagucaagccaaaacaguuuugaaacugucuccaccgagguggaccuaaaggggacaugcguacucaaacacaagaugguugaagagucuuaucggagccgcaaguccgugaccuguuacgaucugucaugcaauaguacuuauuguaaaccaacacuuuacaugauuguccccauccaugcgugcaacaugaugaaaagcugucugauugcuuugggaccuuaucgaguccaggugguguacgagcguaccuacugcaugacgggcguucucaucgaagguaaguguuucgugccagaccagucuguaguguccauaaucaagcacgggauuuuugauaucgccucaguccauauugugugcuucuuuguugcagugaaaggaaauacuuauaagaucuucgagcaggucaagaaaaguuuugaaagcaccuguaacgacacagagaauaaggugcaaggcuacuauauaugcauuguaggcgggaacucugcccccaucuacguuccuacucuggaugacuucagauccauggaggcuuuuaccggaauuuucaggagcccacacggugaagaucacgaccuggcaggcgaggaaaucgccucguauucuaucguggggccggcuaaugccaaagucccccauuccgcgucaagugauacacucagcuuaauugcauacuccggaauaccuucuuauagcucacugaguauccuuaccuccagcacggaggccaagcacguguuuucuccaggcuuguuccccaaacugaaccauacuaauugcgacaagucagcuauuccucuaaucuggacagguaugauagaccucccaggguacuacgaagccguccaccccuguaccguguuuugcguucugaguggaccgggcgcaagcugugaggcuuucuccgagggcgggauuuucaacaucacuucuccuaugugccuugugucgaaacagaaucgguuucgccugacagaacagcagguaaacuucgucugucaaagaguggauauggacaucguuguguauugcaacggacagaggaaggucauuuugaccaagacgcucgugaucggucaguguauuuacaccauaacaagccuguuuuccuuacugcccggcguagcccacucaaucgcgguggagcucugcguuccaggguuccauggaugggccacugcagcccuucuggucaccuuuuguuucggcuggguguugauuccugcuaucacauuuaucauucuaacugugcugaaauucauagcuaauaucuuucacaccaguaaccaagaaaaucggcucaagucuguccugcgcaaaauuaaggaggaauuugagaaaacaaaggguagcaugguuugcgauguguguaaguaugagugcgaaaccuacaaagagcuuaaggcccaugggguguccugcccccagucacaguguccauauugcuucacucacugugaacccacggaggcagccuuccaggcucauuacaaaguaugccaagucacacaccgauuuagagacgaucugaagaaaaccgugacuccucagaacuucaccccaggcuguuauaggacauugaaucucuuccgguacaagagccguugcuacaucuuuaccauguggauuuuccuguuaguucuggaaucuauccuaugggcggcauccgccagugagacuccgcucacacccguguggaacgacaaugcucacggagucggcagcgugccuaugcauacggaucuggagcuugacuuuucuuugaccuccucaaguaaguauacuuaccgcagaaaacugacaaacccacucgaagaggcccagagcauagaucugcacaucgaaauugaggagcagaccaucgggguugacgugcaugcacuuggacacugguucgaugguaggcugaauuugaagacaucguuucacuguuauggcgccugcacuaaauacgaauaucccuggcauaccgcuaagugucacuacgagcgggacuaucaauacgaaacguccugggggugcaacccuucugacuguccaggaguaggcaccgguugcacagccugcgggcucuaccuggaucaguuaaaacccgucggcagcgcauauaagauuaucacuauacgauacucacgcagagugugugugcaguucggagaggaaaaucugugcaagauuaucgacaugaacgauuguuuugucaguaggcauguuaaagugugcauuaucggcaccguauccaaguucucucagggggacacacuacucuuuuucggaccgcuggaggguggcgggcuuauauuuaaacacugguguacuagcacgugccaauucggagauccuggcgacaucauguccccacgggauaagggguuuuugugucccgaguucccugggucauuccgcaaaaagugcaauuuugcgaccacacccauuugugaauaugacggcaacauggugagcggauacaaaaaggucauggcuaccaucgauaguuuccagucuuuuaauacuuccacaaugcauuucaccgacgagagaauugaauggaaggauccagacggcaugcugagggaucacaucaacauacucgugacuaaagacauugacuuugauaaccugggggagaauccuugcaagaucggauuacagaccagcucgaucgaaggcgccugggguucagggguuggauucacacugacgugucuugugucuuugaccgagugccccacuuuucucacaaguauuaaagcaugcgacaaggccaucuguuauggcgcugaguccgucacccugacacguggucagaacacugugaaaguuagcggcaaggguggacacucuggcagcaccuuccggugcugucauggggaagauugcucccaaauuggacuacacgccgcagcuccacaucuggacaaggugaauggcauaucagagaucgaaaacaguaaagucuacgaugacggugccccgcagugugggauuaagugcugguuuguaaaaagcggagaguggaucucuggcauuuucuccgguaauuggaucgugcucauaguucuguguguguuucuuuuguucucacuggucuuacucaguauccugugcccugugcgaaagcacaaaaagagcuga

SEQ ID NO: 10032 - RNA, 3408 nt, Artificial Sequence
  derived and/or modified CDS sequence (opt3) from HTNV(A16)__AF288645.1__GP
augggccuguggaaguggcucaucauggccgugcuugucuggcccugcuucgcucugagaaacguuuacgacaugaaaauugaguguccucacaccgugaauuuuggggaaaacagcguagugggauaugucgaguugccaccgaugcccauagcagauaucacacagaugaugccugaauccucuugcucaauggacaaucaucaaaguuuaaacacuauuacgaaguacacccaggugagcuggaggaaaaaggccgaucaggcgcaguccucucaaacaucguucgagacuguuucaagcgaaguggacuuuaaagguaccuguguccugaagcacaagaugaucgaggauaguuaucggucccgccgaucuauuaucugcuacgaccuaagcuguaauuccacauucugcaaaccaacccucuaucugauagugcccguacaugcuuguaacaugaugaagucaugccuuaucgcccugggcccuuaccguguucagguggucuaugagagaacuuacuguaugagugggguguugcucgaaggaaaaugcuuugugccagaucagagcgucguuucuauuaucaagcacggcauuuucgacaucgcauccgugcauauaguaugcuuuuucguggccauuaaagguucaacauacaagauccuggagcaggucaagaaaaguuuugaacugaccuguaaugauacggacaacaagauucaaggguauuacaucugccucgugggaggcaauagugcucccaucuauguuccuacuuuagaugacuucaggucuauggaggcauuugccggcauuuucaaauccccacacggggaggaucacgaccuggcuggagaagagguggccagcuacucgauagucgguccggcgaacgcaaaggugccccauucugccuccgcugacacccuuggcuugguagccuuuucagggaucccuaguuauagcuccuucucuguucugacaggaagcacugaugcacggcacguguucucaccaggcuuuuucccccagcuaaaucagacccgcugugacaaaacagcuauuccucucaccuggacggguaugaucgaucugccaggguacuaugaagccguccaucccugcacuguguuuuguguccuuaguggaccgggcgcguccugcgaggccuucagcgaaggcgggauauuuaacauuacaucuccuaugugucuggugucaaagcagaauagauucaggaguagcaaacaacagguuaacuuugugugccagcggguagacauggauaucgucguguacuguaauggacaaaagaagguuaucuugaccaaaacucucgugauuggucagugcaucuacacaauuaccucccuguucucuuuacugcccggcgucgcacacucgauagcuguggagcucuguguaccaggguuucacggaugggccacggcugcccuucuggugaccuucugcuuuggcuggguuuugaucccugcagucacccuagugauucugacuauccucaaguucaucgccaacauuuuucauaccagcaaccaggagaaucgccugaaauccgugcuuaagaaaauaaaggaagaguucgaaaagacaaaagguucaauggucugugacguuugcaaguaugagugcgaaacuuacaaagagcugaaggcucacggggugaguuguccccagucucaaugcccauauuguuucacccauugcgagcccacagaagcggcauuucaggcccacuacaaagugugucagguaacccaucgauucagagaugacuugaagaagacugucacgccucagaacuuuacaccaggcugcuauaggacccucaaucuguuccgguacaaaagccguuguuauaucuuuacuauguggguguucuuacugauucuagaguccauccucugggcugccucagcaagcgaaaccccgcugacacccauuuggaacgauaaugcccacggaguuggcucuaucccuaugcacaccgaccuugaguuggauuuuucccugacuagcagcucuaaguacacauaccgcagaaaacucacgaacccacuggaagagacccaagcuguggaccuucauauagagcuggccgaacagacuaucggggucgacgugcacgcauugggacauugguucgaugguaggcucaaucugaagacauccuuucacugcuauggcgcguguaccaaauacgaguaucccuggcacacagcuaagugccauuacgaacgggacuaucaguacgagacuucauggggguguaacccuagugauugcccaggaguuggcaccgguugcacggccuguggguuauaucuggaccagcuaaagcccgugggcagcgcauacaaaauuaucaccauucgauacucgcgcagaguaugcguccaauucggagaggaaaaucucuguaaggugaucgauaugaacgacugcuuuguguccaggcacgucaaaguuuguauaauuggcacagugucuaaguucagccagggggauacucugcucuuuuucggaccguuggaggguggcgggcugaucuucaaacauuggugcaccucaacaugucaguuuggagacccuggcgauauuaugaguccacgggacaaggguuuccucugccccgaauuuccuggguccuuccgcaaaaaguguaauuuugccacuacaccccugugcgaguaugauggcaacaugaucucuggauacaagaaaguaauggcuacgauagacagcuuccaguccuuuaauacaucaaccaugcacuucacugaugaaagaaucgaguggaaggacccagacggcauguuaagggaucauauuaacauccuggugacaaaagacauugauuuugacaaucuuggggagaacccuuguaagaucggauugcaaaccagcaguauagaaggcgccugggguucuggggucggauucacucuuaccugccuggugucccuaacagagugccccacguuucugaccagcauuaaagcaugugauaaggcuaucugcuauggcgccgaaucgguuacucucacacguggucagaacaccgugaaggucucaggcaaagggggacacucuggcaguacauucaaguguugccacggggaggacuguucccagacuggacugcaugcggccgcuccacaccuugauaaagugaauggcaucagcgaaauugagaacucuaagguuuacgacgauggugcaccgcaaugcgggaucaaauguugguucgucaagagcggagaguggauuuccggcauauuuucagguaauuggaucguguugauuguacugugcguguucuuacucuuuagucugguucuucugagcguguuguguccuguccggaagcauaaaaagucuuga

SEQ ID NO: 10033 - RNA, 3408 nt, Artificial Sequence
  derived and/or modified CDS sequence (opt3) from HTNV(A9)__AF035831.1__GP
augggcaucuggaaguggcuggugauggccagccucgucuggcccgcuuacacccuuagaaacgcauaugacaugaaaauugagugcccucacacaguuuccuucggggaaaauucugugauaggauacguagagcugccaccgauccccuuggccgauacuacgcagauggugccugaaucaaguuguagcauggacaaccaucaauccuuaaauaccauuacaaaguauacucaggucucuuggagggguaaagcggaucacgcucaggccucgcagaacucauuugaggcagugagcgccgaaguugaccugaaggggaccugcgugcuaaaacauaagaugcucgaggagaguuaccggucccgcaagucuaucgcuuguuaugaucugagcugcaauuccacauacuguaaaccaacccuuuauaugauuguccccauccacgcaugcaacaugaugaagucaugucugauagccuuggggccucaucgagugcaaguaguuuacgaacguacuuacugcaugacaggagugcucaucgagggcaaauguuucgucccagaccagaguguggugagcauuaucaagcacgguauuuuugauaucgcuucuguccacauaguuugcuucuuuguggccguaaaagggaauaccuauaagauuuucgaacagaucaagaaauccuuugagucaacguguaacgacacuaagaauaaagugcagggauacuauauuugcaucgucggcggcaacagcgcgcccaucuacgugccuacccuggaugacuucagaaguauggaggcauuuucugggauuuucagguccccacauggagaagaucacgaccuggccggugaggaaauagcuagcuauucgaucguuggcccggccaaugcaaaggugccccauucugcuuccucagauacacucaguuuaacugccuacagcgggauuccuuccuauucuagccugucaauccuugcgggaagugccgaggcaaaacacgucuuuuccccaggcuucuuuccccaauugaaccacaccaagugcgacaaaacagcuauaccucugauguggaccgguaugauugaccuaccaggguacuacgaagccauccaucccuguacgguguucugcguacucagcggaccgggcgcuucuugugaggccuucucagagggcgggaucuuuaauauuacaaguccuaugugccugguuagcaagcagaaccgguuccgccuuacugaacaacaggugaauuuugucugucagagaguggauauggacaucauugucuauugcaacggacagaggaaggugauacugaccaaaacuuugguuaucggucaguguauuuacacaaucaccucccucuucucucuguuacccggcguggcacacucgaucgccguagagcugugcgucccaggguuucauggaugggcuacggcggcacuccuugugaccuucuguuuuggcuggguucugauuccugccaugacauucauaguguugacuauccuaaaguuuauugcuaacaucuuccacaccagcaaucaagaaaacaaacugaaguccguccuccggaaaauuaaggaggaauuugagaagacaaaagguucaauggugugcgauguauguaaguaugagugcgaaacuuacaaagagcugaaggcccauggggugaguugcccccagucucaguguccauauugcuucacccacugugaacccacagaggcagccuuucaggcucacuaccgcguuugccaagucacccaucgauucagagacgaucuuaaaaagacugugacgccucagaauuucacaccaggcuguuauaggacccugaacuuguuucgguacaagagccguugcuacaucuucacuauguggguguuucuccuggucuuagaauccauacugugggccgcaucagcgagcgagaucccgcuaaaucccguuuggaacgacaaugcucacggagugggcucugugccuaugccaaccgaucucgagcuggacuucucccuuacaaguagcucuaaauauaccuaccgcagaaaguugacuaacccccuggaagagucccaggccauuaaucuccauaucgaaauugaggagcagacaaucgggguagauguccacgcacugggacacugguuugacgguaggcuuaaccugaaaacgucauuccauuguuauggcgccugcaccaaguacgaauauccuuggcacacugcuaaaugucauuacgagcgggauuaucaauacgaaacaaguugggggugcaauccaagcgacugucccggagugggcaccgguugcacagccugcggguuguaccucgaccagcugcgagcaguuggcucggcuuauaagauaauuacuauccgcuacuccagaaggguguguguccaguuuggagaggaaaacuuaugcaagauuaucgauaugaaugacuguuucgugucucggcacguuaaagugugcauaaucggcaccguaagcaaguuuucacagggggauacgcugcuauucuuuggaccgcucgaggguggcgggcugauuuucaaacauugguguaccaguacaugccaauuuggagacccuggcgauaucauguccccacgcgacaaggguuuccuuugucccgaguucccugggucuagcaggaaaaagugcaacuuugccacuacccccuugugugaauaugauggcaauauggucuccggauacaaaaaggugauggcgacaauugacucauuccagagcuuuaacaccaguacuaugcacuucacggaugagagaaucgaauggaaggacccagauggcaugcugcgugaccacauaaacauucucgugacaaaagauaucgacuuugagaaucugggcggaaacccuugcaagaucggcuuacagaccucuuccauugaaggugccugggggagcggagucggcuucacucugacaugucuuguuucguugaccgagugccccacuuuucucaccucaaucaaggcuugcgacaaagcaauuuguuauggugccgagucugugacacugacgcggggccagaauaccguaaaagugagugggaagggaggccauuccgggagcacuuucaagugcugucacggagaagagugcucucaaauaggccuacaugcugccgcaccacaccuggauaaagucaacgguaucagcgaaauugagaauaacaagguguacgacgauggggcgccgcaguguggaaucaaaugcugguuuguuaaguccggcgaauggauuucagguaucuucaguggcaauuggauagugcucaucguccuguguguguuucuuuuguucagccugauuuuacucucuauccugugcccuguucgaaaacauaagaaguccuga

SEQ ID NO: 10034 - RNA, 3408 nt, Artificial Sequence
  derived and/or modified CDS sequence (opt3) from HTNV(84FLi)__AF345636.2__GP
augggcguguggaaguggcuggucauggccagccucguuuggcccgcuugcacccuuagaaacguguacgacaugaaaaucgaguguccucacacaguauccuucggggaaaauucugugauuggauaugucgagcugccaccgaugcccuuggcagauacuacgcaguuagugccugaaucaaguugcagcauggacaaccaucaaucccugaauaccauaacaaaguacacucagguuucuuggaggaaaaaggccgaucaggcgcagucgucacaaaacagcuuugagaccgugagugucgaaguggaccuaaaagguacauguguacucaagcacaagaugaucgaggaguccuaucggucucgcaaaagcauuaccugcuacgaucuguccuguaauucaacuuauugcaagccaacacuuuacaugaucguucccauucaugcuuguaacaugaugaaaaguugccugaucgccuugggcccuuaucgagugcaggucguguacgaacguaccuacuguaugacgggggugcucauagagggaaagugcuucgucccagaccagagcguugugucuaucauuaaacacggcaucuuugauauugcauccguaaagaucguguguuucuuugucgccgugaaggguaauacuuauaaacuguucgaacagguuaagaaaucauuugacaguaccugcaacgauacagagaauaaggugcaaggguacuauauaugcauugucggaggcaacagcgcucccaucuacgugccuacucuggacgauuucagaucuauggaggcauuuuccggcauuuucaggagcccacauggggaagaccacgaucucgccggagaggaaguagcuucguauucuaucguugguccggccaaugcgaaagugccccacuccgcaucaagugacaccuuaagccugaucgccuacuccggcauuccuucuuauagcucacuuaguauauugacauccagcaccgaggcuaagcaugucuuuucuccaggguucuuuccccagcugaaccacacgaaaugugacaagacugccaucccucuaacauggaccggaaugauugaucucccaggcuacuacgaagcaauccaucugugcacuguguucuguguccuuucaggucccggggcuaguugcgaggccuucagcgagggaggcauauuuaauauuacauccccgaugugucuggugucuaagcagaaccaguuccgguugaccaaacaacagguuaauuuugugugccagcgcguagacauggauaucgucguguauuguaacggccaaagaaagguuauccucacgaaaaccauggugauugggcagugcaucuacacaauuacuucgcuguucagcuuacugccuggagucgcgcacuccauagccguggaacucuguguacccgguuuucacggcugggcaaccgcugcccuucuggugacauucugcuuuggguggguuuugaucccagcugucacuuucauuauccuaaccgugcugaaguuuguggccaacaucuuccauacaucaaaucaggagaacaggcucaaaaguguccugcggaagauuaaggaagaguuugagaaaaccaagggaucuaugguuugugacgugugcaaauaugagugcgagacuuaccgcgaacuuaaggcacacggcgugagcuguccucagucccaaugccccuauuguuucacgcauugcgagccaacagaagccgcuuuucaggcgcacuaccgaguaugucaggucacccauagauucagggaugaccugaaaaagacugugacuccccagaauuucacaccugguugcuaucggaccuugaaccucuuucguuacaagucacgcuguuacauauucacuauguggguuuuucuguuagugcuggagagcauccuaugggcagccucugcuuccgaagucccacucaauccgauuuggaacgauaaugcccacggggugggcaguguucccaugcacacagaccuggagcuugauuucagcuugacgucuuccucaaaauauaccuacagaaggaagcugacuaacccucucgaggaaacacaagcaaucgaccugcauauugagaucgaagaacagaccauaggaguggauguacacgcccuuggccauugguuugacgggcggcugaauuugaaaacaaguuuccacugcuauggagcuuguacuaaguacgaguauccauggcacaccgccaaaugccauuacgaacgagacuaucaguacgagacgagcugggguuguaaccccucggauugcccuggcgucgggaccggaugcacagcauguggccucuaccuggaccaguuaaagccaguggguuccgcguauaagaucauuacuauccgcuacucuagaagggugugcguccaauuuggggaagagaaucuguguaaaguuauugauaugaacgacugcuucgugagccggcacguaaagguguguaucauaggcaccgucucaaaauuuagucagggagauacacuacucuucuuuggcccccuggaagggggaggucuuauuuucaagcauuggugcacuuccaccugucaguuuggcgacccgggggauaucaugucuccucgcgacaaaggauucuugugcccagaguuccccggcagcuuuagaaagaaauguaauuucgcuacgacaccucugugcgaguaugaugguaacaugauuuccggguacaagaaggugauggccaccaucgacucauuucagagcuucaauaccaguacaaugcacuuuaccgaugaaaggauagaguggaaagaccccgauggcaugcuccgugaccauaucaacauucugguuacuaaggacaucgauuucgacaacuuaggagaaaauccauguaaaauuggccugcaaaccucuuccaucgagggggcauggggaagcggcguggguuuuacacuuacgugcuuggucucgcucaccgaaugcccuacuuuccugacaucaauaaaggccugugauaaagcuauuugcuauggggccgagucugugacccuaacacggggacagaacacuguuaaggugaguggcaaggguggccacuccgggagcaccuuuaaauguugccacggagaggacuguucucagacgggccugcaugcagcugcgccccaccucgauaaggucaaugggaucagcgaaaucgagaacuccaaaguauacgacgauggagccccacaaugcggcauuaaguguugguucgugacaucaggugaauggaucagugggauuuuuagcggaaauuggauaguucugaucgugcuuugcgucuucuugcuguucucuuuagugcuccuguccguacuuuguccggugcgaaaacauaagaagucauga

SEQ ID NO: 10035 - RNA, 3408 nt, Artificial Sequence
  derived and/or modified CDS sequence (opt3) from HTNV(Aa03-161)__KT934990.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaaaagcuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaaguuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgaccugccaggguauuacgaggccauacaccccuguacagucuucugcgugcuuucuggaccgggcgcaucaugugaggcuuucagugaaggcgggauuuuuaacaucaccagcccuaugugccuggucuccaaacagaaucgguuccgcuugacggagcaacaggugaacuuuguuugucaaagaguggauguagacaucgucguguacugcaacggacagaggaagguuauucucaccaagacacuggugaucggucaguguauuuauacuauaaccucuuuauucucgcugcuccccggcgucgcccacagcaucgcgguggaacuuugcguaccaggguuucauggaugggccacagcagcucuguuggugacuuucuguuuuggcuggguucuaauuccugccaucaccuucaucauucugacaauacucaaauuuaucgcuaauauuuuccacaccuccaaccaagagaaucggcugaagucaguccuucgcaaaaucaaggaagaguuugagaaaacuaaggguaguauggugugcgauguguguaaguacgaaugcgagacguauaaagaacugaaggcccauggggucucuugcccccagagccaguguccauacugcuucacacacugugagcccaccgaagcagccuuucaggcucauuauaaaguuugccaagugacucaccgauucagagacgauuugaagaaaaccgugacaccucagaacuucaccccaggcuguuacaggacucucaaucuguuucgguauaagucccguugcuacauuuucacaauguggaucuuuuuacugguacuagagucaauacucugggcggcaagcgccucugagacgccgcugacccccgucuggaacgacaaugcucacggagugggcuccguuccuaugcauacugaucuugaauuggacuucagucugacaucuagcuccaaguacaccuaucgcagaaaacucacaaacccacuggaggaagcccagucaaucgaucuucacauugagaucgaggaacagacuauugggguggacguccaugcacugggacacugguuugaugguagguugaaucucaagaccaguuuccacuguuacggcgccugcacgaaauaugaguaccccuggcauaccgcuaagugucacuaugaacgggacuaccaauaugagacaagcugggggugcaacccuucggacuguccaggagugggcacugguugcaccgccugcgggcuguacuuagaucgacugaaacccguuggcuccgcauacaagaucauaacaauucgcuauucuagaaggguguguguacaguuuggagaagagaaucuaugcaagaucauugacaugaacgauuguuucgucagccggcaugugaaagugugcaucauaggcacugucucaaaguuuagucagggggacacccuccuguucuuuggaccgcuugaggguggcggguugaucuucaaacacugguguacguccacaugccaguuuggagauccuggcgacauuaugucuccacgcgauaaggguuuccugugucccgaguucccugggagcuuuagaaagaagugcaauuucgcgaccacucccaucugugaauacgacggcaacaugguuuccggauauaggaaagugauggcuacaauugauucauuucagagcuucaauaccaguacuaugcauuuuaccgacgaacguaucgaguggaaggauccagacggcaugcuccgggaucacauaaacauucugguaacaaaggacaucgacuucgauaacuuaggggaaaauccuugcaaaaucggacugcagacgucuuccauugagggcgccugggguagcggggugggauuuacccuuacuuguuuggucucgcucacagagugccccaccuuccugacaucaaucaaggcaugcgacaaagccauuuguuacggcgcugaaucugugacucuaacccgaggucagaacacgguuaaggugaguggcaaagggggacacuccggcagcacauuuaagugcugucauggggaggauugcucucagauaggacugcacgccgcagcuccacaucucgacaaggucaauggcaucagcgaaauggagaacuccaaaguguaugaugacggugccccgcaaugugggauuaagugcugguucguuaaaucaggagaauggaucaguggcauuuuuagcgguaauuggaucgugcugauaguccuuuguguauucuugcuguucucuuuagugcuccuguccauccuuugcccuguuagaaagcacaaaaagucauga

SEQ ID NO: 10036 - RNA, 3408 nt, Artificial Sequence
  derived and/or modified CDS sequence (opt3) from HTNV(Aa03-386)__KT934991.1__GP
augggcaucuggaaguggcuggugauggccagccucgucuggcccguucuuacccugagaaacguguacgacaugaaaauugagugcccucacacaauauccuucggggaaaauucuguaaucggauauguggaguugccaccgaugcccuuagcugauacugcacagcuggucccugaaucaaguuguagcauggacaaccaucaaucccuaaauacgauuaccaaguacacacaggugucuuggagggguaaagccgaucagucgcagucaagccaaaacaguuuugagacuguuuccaccgaaguggaccucaagggcacaugcguccugaaacacaagaugguggaggagucuuaucggagccgcaaguccaucaccuguuacgaucuuucaugcaauaguacuuauuguaaaccaacacuguacaugauuguacccauccaugcgugcaacaugaugaaaagcuguuugauagcucucgggccuuaucgaguucagguggucuacgaacguaccuacugcaugacgggagugcugaucgagggcaaauguuucgugccagaccagucugucguuuccauuaucaagcacgguauuuuugauaucgccucagugcauauaguaugcuucuuuguggcagucaaagggaauacuuauaagauuuucgaacaggugaagaaaaguuuugagaguaccuguaacgacacagagaauaagguucaaggauacuauaucugcauugugggcggcaacucugcccccaucuacgucccuacucuggaugacuucagauccauggaagcauuuaccgggaucuucaggagcccacacggagaggaucacgaccucgcuggugaagagacagccaccuauucgauugugggcccggcuaaugccaaaguaccccauucugcguccucagauacguuaagucugauagcauuuagcgggaucccuuccuacucuagccuuucaauuuugacuagcuccacagaagccaagcacguuuucagcccaggacuguuucccaaacuaaaccauaccaauugcgacaagggcgcuaucccucucauguggacugguaugauagaccugccaggguauuacgaggccauucaccccuguacaguguucugcguccuuucuggaccgggcgcaucaugugaggcuuucagugaaggcgggaucuuuaacaucaccagcccuaugugccugguguccaaacagaaucgguuccgcuugacggagcagcaggucaacuuugugugucaaagaguugauguggacauuguagucuacugcaacggacagaggaaggugauccucaccaagacacugguuauuggucaguguauauauacuaucaccucuuuauucucgcugcuccccggcguggcccacagcauugcggucgaacuuugcgugccaggguuucauggaugggccacagcagcucuguugguaacuuucuguuuuggcugggugcuaaucccugccaucaccuucauuauacugacaauccucaaauuuauugcuaauaucuuccacaccuccaaccaagagaaucggcugaagucaguucuucgcaaaauuaaggaagaguuugagaaaacuaaggguaguauggucugcgauguguguaaguacgaaugcgagacguauaaagaacugaaggcccauggggugucuugcccccagagccaguguccauacugcuucacacacugugagcccaccgaagcagccuuucaggcucauuauaaagucugccaaguuacucaccgauucagagacgauuugaagaaaaccgugacaccucagaacuucaccccaggcuguuacaggacucucaaucuguuucgguauaagucccguugcuacaucuucacaauguggauauuuuuacuggugcuagagucaauccucugggcggcaagcgccucugagacgccgcugacccccguauggaacgacaaugcucacggagucggcuccgugccuaugcauacugaucuugaauuggacuucagucugacaagcagcuccaaguacaccuaucgcagaaaacucacaaacccacuggaggaagcccagucaauugaucuucacaucgagauugaggaacagacuaucgggguugacgugcaugcacugggacacugguuugaugguagguugaaucucaagaccaguuuccacuguuacggcgccugcacgaaauaugaguaccccuggcauaccgcuaagugucacuaugaacgggacuaccaauaugagacaagcugggggugcaacccuucggacuguccaggagucggcacugguugcaccgccugcgggcuguacuuagaucgacugaaacccgugggcuccgcauacaagauaauuacaauccgcuauucuagaaggguuugugugcaguuuggagaagagaaucuaugcaagauuaucgacaugaacgauuguuucguaagccggcaugucaaagugugcauaaucggcacugugucaaaguuuagucagggggacacccuccuguucuuuggaccgcuugaggguggcggguugauuuucaaacacugguguacguccacaugccaguuuggagauccuggcgacaucaugucuccacgcgauaaggguuuccugugucccgaguucccugggagcuuuagaaagaagugcaauuucgcgaccacucccauuugugaauacgacggcaacauggucuccggauauaaaaagguuauggcuacaaucgauucauuucaaucuuucaauaccaguacuaugcauuuuaccgacgaaaggauagaguggaaggauccagacggcaugcuccgugaucacauuaacauccuggugacaaaagacaucgacuucgauaacuuaggggaaaauccuugcaagauuggacugcagacgucuuccaucgagggcgccugggguagcgggguaggauuuacccuuacuuguuuggugucgcucacagagugccccaccuuccugacaucaauuaaagcaugcgacaaggccauauguuacggcgcugaaucugucacucuaacccggggucagaacacggugaaaguuaguggcaaagggggacacuccggcagcacauuuaagugcugucauggggaggauugcucucagaucggacugcacgccgcagcuccacaucucgacaaggugaauggcauuagcgaaauggagaacuccaaggucuaugaugacggugccccgcaaugugggaucaaaugcugguucgugaagucaggagaauggauuaguggcaucuuuagcgguaauuggauaguucugaucgugcuuuguauuuucuugcuguucucuuuaguccuccuguccauccuuugcccuguacgaaaacacaagaagucauga

SEQ ID NO: 10037 - RNA, 3408 nt, Artificial Sequence
  derived and/or modified CDS sequence (opt3) from HTNV(Aa04-722)__KU207182.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaaaagcuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaaguuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaucauagaccugccaggguauuacgaggccauucaccccuguacagucuucugcgugcuuucuggaccgggcgcaucaugugaggcuuucagugaaggcgggaucuuuaacaucaccagcccuaugugccuggucuccaaacagaaucgguuccgcuugacggagcaacaggugaacuuuguuugucaaagaguggauguagacauugucguguacugcaacggacagaggaagguuauccucaccaagacacuggugauuggucaguguauauauacuaucaccucuuuauucucgcugcuccccggcgucgcccacagcauugcgguggaacuuugcguaccaggguuucauggaugggccacagcagcucuguuggugacuuucuguuuuggcuggguucuaaucccugccaucaccuucauuauacugacaauccucaaauuuauugcuaauaucuuccacaccuccaaccaagagaaucggcugaagucaguccuucgcaaaauuaaggaagaguuugagaaaacuaaggguaguauggugugcgauguguguaaguacgaaugcgagacguauaaagaacugaaggcccauggggucucuugcccccagagccaguguccauacugcuucacacacugugagcccaccgaagcagccuuucaggcucauuauaaaguuugccaagugacucaccgauucagagacgauuugaagaaaaccgugacaccucagaacuucaccccaggcuguuacaggacucucaaucuguuucgguauaagucccguugcuacaucuucacaauguggauauuuuuacugguacuagagucaauccucugggcggcaagcgccucugagacgccgcugacccccgucuggaacgacaaugcucacggagugggcuccguuccuaugcauacugaucuugaauuggacuucagucugacaucuagcuccaaguacaccuaucgcagaaaacucacaaacccacuggaggaagcccagucaauugaucuucacaucgagauugaggaacagacuaucgggguggacguccaugcacugggacacugguuugaugguagguugaaucucaagaccaguuuccacuguuacggcgccugcacgaaauaugaguaccccuggcauaccgcuaagugucacuaugaacgggacuaccaauaugagacaagcugggggugcaacccuucggacuguccaggagugggcacugguugcaccgccugcgggcuguacuuagaucgacugaaacccguuggcuccgcauacaagauaauuacaauccgcuauucuagaaggguguguguacaguuuggagaagagaaucuaugcaagauuaucgacaugaacgauuguuucgucagccggcaugugaaagugugcauaaucggcacugucucaaaguuuagucagggggacacccuccuguucuuuggaccgcuugaggguggcggguugauuuucaaacacugguguacguccacaugccaguuuggagauccuggcgacaucaugucuccacgcgauaaggguuuccugugucccgaguucccugggagcuuuagaaagaagugcaauuucgcgaccacucccauuugugaauacgacggcaacaugguuuccggauauaaaaaggugauggcuacaaucgauucauuucagagcuucaauaccaguacuaugcauuuuaccgacgaaaggauagaguggaaggauccagacggcaugcuccgugaucacauuaacauccugguaacaaaagacaucgacuucgauaacuuaggggaaaauccuugcaagauuggacugcagacgucuuccaucgagggcgccugggguagcggggugggauuuacccuuacuuguuuggucucgcucacagagugccccaccuuccugacaucaauuaaagcaugcgacaaggccauauguuacggcgcugaaucugugacucuaacccggggucagaacacgguuaaagugaguggcaaagggggacacuccggcagcacauuuaagugcugucauggggaggauugcucucagaucggacugcacgccgcagcuccacaucucgacaaggucaauggcauuagcgaaauggagaacuccaagguguaugaugacggugccccgcaaugugggaucaaaugcugguucguuaagucaggagaauggauuaguggcaucuuuagcgguaauuggauagugcugaucguccuuuguguauucuugcuguucucuuuagugcuccuguccauucuuugcccuguucgaaaacacaagaagucauga

SEQ ID NO: 10038 - RNA, 3408 nt, Artificial Sequence
  derived and/or modified CDS sequence (opt3) from HTNV(Aa05-190)__KT934993.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuaacugauacggcucagcuggugccugaaucaaguuguagcauggacaaccaucaaucccuaaauaccaucacaaaguacacucagguuucuuggagggguaaagcagaucagucgcagucaagccaaaacaguuuugagaccguguccacagaagucgaccucaaggggaccugcgugcugaaacacaagaugauugaggagucuuaucggagccgcaaguccaucacuuguuacgaucuuucaugcaauaguacauauuguaaaccaacccuguacaugauuguacccauccaugccugcaacaugaugaaaagcuguuugauagcgcucgggccuuaucgaguucagguggucuacgaacguacguacugcaugacuggagugcugaucgagggcaaauguuucgugccagaccagucugucguuuccauuaucaagcacgguauuuuugauaucgcuucagugcauauaguaugcuucuuuguggccgucaaagggaauaccuauaagauuuucgaacaggugaagaaaaguuuugagaguacauguaacgacacugagaauaagguucaaggauacuauaucugcauugugggcggcaacucugcacccaucuacgucccuacccuggaugacuucagauccauggaagccuuuacagggaucuucaggagcccacacggagaggaucacgaccucgcuggugaagagaccgcaacguauucgauugugggcccggccaaugcuaaaguaccccauucugccuccucagauacuuuaagucugauagcguuuagcgggaucccuuccuacucuagccuuucaauuuugacaaguuccaccgaagcaaagcacguuuucagcccaggacuguuucccaaacuaaaccauacuaauugcgacaagggcgccaucccucucauguggacagguaugauagaccugccaggguauuacgaggcuauucaccccuguaccguguucugcguccuuucuggaccgggcgccucaugugaggcauucagugaaggcgggaucuuuaacaucacgagcccuaugugccugguguccaaacagaaucgguuccgcuugaccgagcagcaggucaacuuugugugucaaagaguugauguggacauuguagucuacugcaacggacagaggaaggugauccucacaaagacucugguuauuggucaguguauauauaccaucacaucuuuauucucgcugcuccccggcguggcucacagcauugccgucgaacuuugcgugccaggguuucauggaugggcgacugccgcacuguugguaaccuucuguuuuggcugggugcuaaucccugcuaucacauucauuauacugaccauccucaaauuuauugccaauaucuuccacacuuccaaccaagagaaucggcugaagucaguucuucgcaaaauuaaggaagaguuugagaaaacgaaggguaguauggucugcgauguguguaaguacgaaugcgagacauauaaagaacugaaggcucauggggugucuugcccccagagccaguguccauacugcuucacccacugugagcccacugaagccgcauuucaggcccauuauaaagucugccaaguuacccaccgauucagagacgauuugaagaaaacagugaccccucagaacuucacuccaggcuguuacaggacacucaaucuguuucgguauaagucccguugcuacaucuucacgauguggauauuuuuacuggugcuagagucaauccucugggcugcgagcgcaucugagaccccgcugacucccguauggaacgacaaugcccacggagucggcuccgugccuaugcauacagaucuugaauuggacuucagucugaccagcuccuccaaguacacauaucgcagaaaacucacuaacccacuggaggaagcucagucaauugaucuucacaucgagauugaggaacagaccaucgggguugacgugcaugcccugggacacugguuugaugguagguugaaucucaagacgaguuuccacuguuacggcgcaugcaccaaauaugaguaccccuggcauacagccaagugucacuaugaacgggacuaccaauaugagacuagcugggggugcaacccuucggacuguccaggagucggcaccgguugcacagcuugcgggcuguacuuagaucgacugaaacccgugggcuccgccuacaagauaauuacuauccgcuauucuagaaggguuugugugcaguuuggagaagagaaucuaugcaagauuaucgacaugaacgauuguuucguaagccggcaugucaaagugugcauaaucggcaccgugucaaaguuuagucagggggacacgcuccuguucuuuggaccgcuugaggguggcggguugauuuucaaacacugguguacaucuaccugccaguuuggagauccuggcgacaucaugucuccacgcgauaaggguuuccugugucccgaguucccugggagcuuuagaaagaagugcaauuucgcaacuacacccauuugugaauacgacggcaacauggucuccggauauaaaaagguuauggcgaccaucgauucauuucagagcuucaauacuagcaccaugcauuuuacagacgaaaggauagaguggaaggauccagacggcaugcuccgugaucacauuaacauccuggugacgaaagacaucgacuucgauaacuuaggggaaaauccuugcaagauuggacugcaaaccucuuccaucgagggcgcuugggguagcgggguaggauuuacucuuacauguuuggugucgcucaccgagugccccacauuccugacuucaauuaaagccugcgacaaggcaauauguuacggcgccgaaucugucacccuaacgcggggucagaacacagugaaaguuaguggcaagggcggacacuccggcagcaccuuuaagugcugucauggggaggauugcucucagaucggacugcacgcugccgcaccacaucucgacaaagugaauggcauuagcgaaauggagaacuccaaggucuaugaugacggugcuccgcaaugugggaucaaaugcugguucgugaagucaggagaauggauuaguggcaucuuuagcgguaauuggauaguucugaucgugcuuugugucuucuugcuguucucuuuaguacuccuguccauucuuugcccugugcgaaaacacaagaagucauga

SEQ ID NO: 10039 - RNA, 3408 nt, Artificial Sequence
  derived and/or modified CDS sequence (opt3) from HTNV(Aa09-1000)__KT935001.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaaaagcuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaaguuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgaccugccaggguauuacgaggccauacaccccuguacagucuucugcgugcuuucuggaccgggcgcaucaugugaggcuuucagugaaggcgggauuuuuaacaucaccagcccuaugugccuggucuccaaacagaaucgguuccgcuugacggagcaacaggugaacuuuguuugucaaagaguggauguagacaucgucguguacugcaacggacagaggaagguuauucucaccaagacacuggugaucggucaguguauuuauacuauaaccucuuuauucucgcugcuccccggcgucgcccacagcaucgcgguggaacuuugcguaccaggguuucauggaugggccacagcagcucuguuggugacuuucuguuuuggcuggguucuaauuccugccaucaccuucaucauucugacaauacucaaauuuaucgcuaauauuuuccacaccuccaaccaagagaaucggcugaagucaguccuucgcaaaaucaaggaagaguuugagaaaacuaaggguaguauggugugcgauguguguaaguacgaaugcgagacguauaaagaacugaaggcccauggggucucuugcccccagagccaguguccauacugcuucacacacugugagcccaccgaagcagccuuucaggcucauuauaaaguuugccaagugacucaccgauucagagacgauuugaagaaaaccgugacaccucagaacuucaccccaggcuguuacaggacucucaaucuguuucgguauaagucccguugcuacauuuucacaauguggaucuuuuuacugguacuagagucaauacucugggcggcaagcgccucugagacgccgcugacccccgucuggaacgacaaugcucacggagugggcuccguuccuaugcauacugaucuugaauuggacuucagucugacaucuagcuccaaguacaccuaucgcagaaaacucacaaacccacuggaggaagcccagucaaucgaucuucacauugagaucgaggaacagacuauugggguggacguccaugcacugggacacugguuugaugguagguugaaucucaagaccaguuuccacuguuacggcgccugcacgaaauaugaguaccccuggcauaccgcuaagugucacuaugaacgggacuaccaauaugagacaagcugggggugcaacccuucggacuguccaggagugggcacugguugcaccgccugcgggcuguacuuagaucgacugaaacccguuggcuccgcauacaagaucauaacaauucgcuauucuagaaggguguguguacaguuuggagaagagaaucuaugcaagaucauugacaugaacgauuguuucgucagccggcaugugaaagugugcaucauaggcacugucucaaaguuuagucagggggacacccuccuguucuuuggaccgcuugaggguggcggguugaucuucaaacacugguguacguccacaugccaguuuggagauccuggcgacauuaugucuccacgcgauaaggguuuccugugucccgaguucccugggagcuuuagaaagaagugcaauuucgcgaccacucccaucugugaauacgacggcaacaugguuuccggauauaaaaaggugauggcuacaauugauucauuucagagcuucaauaccaguacuaugcauuuuaccgacgaaaggaucgaguggaaggauccagacggcaugcuccgugaucacauaaacauucugguaacaaaagacaucgacuucgauaacuuaggggaaaauccuugcaagaucggacugcagacgucuuccauugagggcgccugggguagcggggugggauuuacccuuacuuguuuggucucgcucacagagugccccaccuuccugacaucaaucaaagcaugcgacaaggccauuuguuacggcgcugaaucugugacucuaacccggggucagaacacgguuaaagugaguggcaaagggggacacuccggcagcacauuuaagugcugucauggggaggauugcucucagauaggacugcacgccgcagcuccacaucucgacaaggucaauggcaucagcgaaauggagaacuccaagguguaugaugacggugccccgcaaugugggauuaaaugcugguucguuaagucaggagaauggaucaguggcauuuuuagcgguaauuggaucgugcugauaguccuuuguguauucuugcuguucucuuuagugcuccuguccauccuuugcccuguucgaaaacacaagaagucauga

SEQ ID NO: 10040 - RNA, 3408 nt, Artificial Sequence
  derived and/or modified CDS sequence (opt3) from HTNV(Aa09-948)__KT935000.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaaaagcuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaaguuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgaccugccaggguauuacgaggccauacaccccuguacagucuucugcgugcuuucuggaccgggcgcaucaugugaggcuuucagugaaggcgggauuuuuaacaucaccagcccuaugugccugaucuccaaacagaaucgguuccgcuugacggagcagcaggucaacuuugugugucaaagaguugauguggacauuguagucuacugcaacggacagaggaaggugauccucaccaagacacugguuauuggucaguguauauauacuaucaccucuuuauucucgcugcuccccggcguggcccacagcauugcggucgaacuuugcgugccaggguuucauggaugggccacagcagcucuguugguaacuuucuguuuuggcugggugcuaaucccugccaucaccuucauuauacugacaauccucaaauuuauugcuaauaucuuccacaccuccaaccaagagaaucggcugaagucaguucuucgcaaaauuaaggaagaguuugagaaaacuaaggguaguauggucugcgauguguguaaguacgaaugcgagacguauaaagaacugaaggcccauggggugucuugcccccagagccaguguccauacugcuucacacacugugagcccaccgaagcagccuuucaggcucauuauaaagucugccaaguuacucaccgauucagagacgauuugaagaaaaccgugacaccucagaacuucaccccaggcuguuacaggacucucaaucuguuucgguauaagucccguugcuacaucuucacaauguggauauuuuuacuggugcuagagucaauccucugggcggcaagcgccucugagacgccgcugacccccguauggaacgacaaugcucacggagucggcuccgugccuaugcauacugaucuugaauuggacuucagucugacaagcagcuccaaguacaccuaucgcagaaaacucacaaacccacuggaggaagcccagucaauugaucuucacaucgagauugaggaacagacuaucgggguugacgugcaugcacugggacacugguuugaugguagguugaaucucaagaccaguuuccacuguuacggcgccugcacgaaauaugaguaccccuggcauaccgcuaagugucacuaugaacgggacuaccaauaugagacaagcugggggugcaacccuucggacuguccaggagucggcacugguugcaccgccugcgggcuguacuuagaucgacugaaacccgugggcuccgcauacaagauaauuacaauccgcuauucuagaaggguuugugugcaguuuggagaagagaaucuaugcaagauuaucgacaugaacgauuguuucguaagccggcaugucaaagugugcauaaucggcacugugucaaaguuuagucagggggacacccuccuguucuuuggaccgcuugaggguggcggguugauuuucaaacacugguguacguccacaugccaguuuggagauccuggcgacaucaugucuccacgcgauaaggguuuccugugucccgaguucccugggagcuuuagaaagaagugcaauuucgcgaccacucccauuugugaauacgacggcaacauggucuccggauauaaaaagguuauggcuacaaucgauucauuucaaucuuucaauaccaguacuaugcauuuuaccgacgaaaggauagaguggaaggauccagacggcaugcuccgugaucacauuaacauccuggugacaaaagacaucgacuucgauaacuuaggggaaaauccuugcaagauuggacugcagacgucuuccaucgagggcgccugggguagcgggguaggauuuacccuuacuuguuuggugucgcucacagagugccccaccuuccugacaucaauuaaagcaugcgacaaggccauauguuacggcgcugaaucugucacucuaacccggggucagaacacggugaaaguuaguggcaaagggggacacuccggcagcacauuuaagugcugucauggggaggauugcucucagaucggacugcacgccgcagcuccacaucucgacaaggugaauggcauuagcgaaauggagaacuccaaggucuaugaugacggugccccgcaaugugggaucaaaugcugguucgugaagucaggagaauggauuaguggcaucuuuagcgguaauuggauaguucugaucgugcuuugugucuucuugcuguucucuuuaguacuccuguccauucuuugcccugugcgaaaacacaagaagucauga

SEQ ID NO: 10041 - RNA, 3408 nt, Artificial Sequence
  derived and/or modified CDS sequence (opt3) from HTNV(Aa10-434)__KT935004.1__GP
augggcaucuggaaguggcuggugauggccagccucgucuggcccguucuuacccugagaaacguguacgacaugaaaauugagugcccucacacaguauccuucgggggaaauucugugauagguuaugucgaauugccaccgaugcccuuagcugauacugcacagcuggugccugagucaaguuguagcauggacaaccaucaaucccuaaauacgaucaccaaguacacacagguuucuuggaggggcaaagccgaucagucgcagucaagccaaauuaguuuugaaacuguguccaccgaggucgaccucaaggggacaugcgugcugaaacacaagaugguagaagagucuuaucggagccgcaaguccaucaccuguuacgaucuuucaugcaacaguacuuauuguaaaccaacacuguacaugauuguucccauccaugcgugcaauaugaugaaaagcuguuugauagcucucggaccuuaucgagugcaggucguguacgagcguaccuacugcaugacgggcgugcugaucgaagguaaauguuucgucccagaccagucuguuguguccauuaucaagcacgggauuuuugauaucgccucaguacauauagugugcuucuuugucgcagugaaaggaaacacuuauaagauuuucgagcagguuaagaaaaguuuugaaaguaccuguaaugacacagagaacaaggugcaaggcuacuauaucugcauugucggcgggaauagcgcccccaucuacgugccuacucuggaugacuucagauccauggaggcuuuuaccggaaucuucaggagcccacacggugaagaucacgaccucgcaggcgaggaaacagccaccuauucgauuguagggccggcuaacgccaaaguuccccauucugcguccucagauacguuaagucugauagcauuuagcggaaucccuuccuacucuagccuuucaauuuugacuagcuccacagaggccaagcacguguucagcccaggccuguuucccaaacuaaaucauaccaacugcgacaagggugcuaucccucucauguggacugggaugauagaccugccaggauauuacgaagccauucaccccuguacagucuucugcgugcuuucuggcccgggcgcaucaugugaggcuuucagugaagggggaaucuuuaauaucaccagcccuaugugccuggucuccaaacagaaccgguuccgcuugacggagcaacaggugaauuuuguuugucaaagaguggauguagacauugucguguacugcaacggucagaggaagguuauccucaccaagacacuggugauuggccaguguauauauacuaucaccucuuuauucucgcugcuccccggggucgcccacagcauugcgguggagcuuugcguaccaggauuucauggcugggccacagcagcucuguuggugacuuucuguuuugguuggguucuaaucccugccaucaccuucauuauacugacaauccucaaauuuauugcuaacaucuuccacaccuccaaucaagaaaaccggcugaagucaguccuucgcaaaauuaaggaggaauuugagaaaacuaaggggaguauggugugcgauguguguaaguacgagugcgaaacguauaaagagcugaaggcccauggcgucucuugcccccagagccaguguccauacugcuucacacacugugaacccaccgaggcagccuuucaggcucauuauaaaguuugccaagugacucaccgauucagagacgauuugaagaaaaccgugacaccucagaauuucaccccaggauguuacaggacucucaaccuguuucgguauaagucccguugcuacaucuucacaauguggauauuuuuacugguacuagaaucaauccucugggcggcaagcgccucugagacgccgcugacccccgucuggaaugacaacgcucacggcgugggguccguuccuaugcauacugaucuugaguuggacuucagucugacaucuucuuccaaguacaccuaucgcagaaaacucacaaauccacuggaagaggcccagucaauugaucuucacaucgaaauugaggagcagacuaucggaguggacguccaugcacugggucacugguuugauggcagguugaaccucaagaccaguuuccacuguuacggggccugcacgaaauaugaauaccccuggcauaccgcuaagugucacuaugagcgggacuaccaauaugaaacaagcuggggaugcaauccuucggacuguccaggcguggguacugggugcaccgccugcggccuguacuuagaucgacugaaacccguuggauccgcauacaagauaauuacaauccgcuauucuagaaggguguguguacaguuuggcgaggaaaaccuaugcaagauuaucgacaugaaugauuguuucgucagccggcaugugaaagugugcauaaucgggacuauuucaaaguuuagucagggagacacccuccuguucuuugguccgcuugagggcgggggauugaucuucaaacacugguguacguccacaugccaguuuggcgauccuggugacauuaugucuccacgcgauaagggguuccugugucccgaguucccuggcagcuuuagaaagaagugcaacuucgcgaccacucccaucugugaauacgacggaaauauggucuccggcuauaaaaagguuauggcuacaauagauucauuucagagcuucaacaccaguacuaugcauuuuaccgacgagaggauugaauggaaggauccagacgggaugcuccgugaucacaucaauauccuggugacaaaagacauugacuucgauaacuuaggagagaacccuugcaagaucggccugcaggccucuuccauugaaggugcaugggggagcggaguaggcuuuacgcuuaccuguuuggugucgcucacugagugccccacauuccugaccucaauaaaagccugcgacaaggcuaucuguuacggugccgagucugucacacuaacucggggccagaauaccgugaaaguuagugggaagggaggccacuccgggagcacguuuaagugcugucauggagaagauugcucucagauuggccugcacgcagcugccccacaucucgacaaagugaacgguaucagcgagauggaaaauuccaaggucuaugaugacggggcgccgcaauguggaauuaaaugcugguucgugaagucaggcgaguggaucagugguauauuuagcggcaacuggaucguucugauugugcuuugugucuucuugcuguucucuuuaguacuccuguccauccuuugcccugugcgaaaacacaagaagucauga

SEQ ID NO: 10042 - RNA, 3408 nt, Artificial Sequence
  derived and/or modified CDS sequence (opt3) from HTNV(Aa10-518)__KT935005.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaagaguuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaucuuuugagaguaccuguaacgacacaaagaauaaagugcaaggauacuauauuugcaucgucggcggcaacucugcccccauuuacgugccuacucuggaugacuucagauccauggaggcuuuuaccgggaucuucaggagcccacacggagaagaucacgaccucgcaggggaggaaacagccaccuauucgaucguaggcccggcuaaugccaagguuccccauucugcguccucagauacguuaagucugauugcauuuagcgggauaccuuccuacucuagccuuucaaucuugacuagcuccacagaggccaaacacguguucagcccaggacuguuucccaagcuaaaccauaccaauugcgacaaaggcgcuauuccucucauguggacugguaugaucgaccugccaggguauuacgaagccauacaccccuguacagucuucugcgugcuuucuggaccgggcgcaucaugugaggcuuucagugagggcgggauuuuuaacaucaccagcccuaugugccuggucuccaagcagaaucgguuccgcuugacggaacaacaggugaacuuuguuugucaaagaguggauguagacaucgucguguacugcaacggacagaggaagguuauucucaccaaaacacuggugaucggucaguguauuuauacuauaaccucuuuauucucgcugcuccccggcgucgcccacagcaucgcgguggagcuuugcguaccaggguuucauggaugggccacagcagcucuguuggugacuuucuguuuuggcuggguucuaauuccugccaucaccuucaucauucugacaauacucaaguuuaucgcuaauauuuuccacaccuccaaccaagaaaaucggcugaaaucaguccuucgcaagaucaaagaggaauuugagaagacuaaggguaguauggugugcgauguguguaaauacgagugcgaaacguauaaggagcugaaagcccauggggucucuugcccccagagccaguguccauacugcuucacacacugugaacccaccgaggcagccuuucaggcucauuauaagguuugccaagugacucaccgauucagagacgauuugaaaaagaccgugacaccucagaacuucaccccaggcuguuacaggacucucaaucuguuucgguauaagucccguugcuacauuuucacaauguggaucuuuuuacugguacuagaaucaauacucugggcggcaagcgccucugagacgccgcugacccccgucuggaacgacaaugcucacggagugggcuccguuccuaugcauacugaucuugaguuggacuucagucugacaagcagcuccaaauacaccuaucgcagaaagcucacaaacccacuggaagaggcccagucaaucgaucuucacauugaaaucgaggagcagacuauugggguggacguccaugcacugggacacugguuugaugguagguugaaucucaaaaccaguuuccacuguuacggcgccugcacgaaguaugaauaccccuggcauaccgcuaaaugucacuaugagcgggacuaccaauaugaaacaagcugggggugcaacccuucggacuguccaggagugggcacugguugcaccgccugcgggcuguacuuagaucgacugaagcccguuggcuccgcauacaagaucauaacaauucgcuauucuagaaggguguguguacaguuuggagaggaaaaucuaugcaaaaucgucgacaugaacgauuguuucgugagccggcaugugaaggucugcauuaucggcacuguuucaaaauuuagucagggggacacccuccuguucuuuggaccgcuugaggguggcggguugauauucaagcacugguguacguccacaugccaguuuggagauccuggcgacaucaugucuccacgcgauaaagguuuccugugucccgaguucccugggagcuuuagaaagaaaugcaauuucgcgaccacucccauuugugaauacgacggcaacaugguguccggauauaagaagguaauggcuacaaucgauucauuucagagcuucaauaccaguacuaugcauuuuaccgacgagaggauugaauggaaagauccagacggcaugcuccgugaucacaucaacauacuggugacaaaggacauugacuucgauaacuuaggggagaauccuugcaaaaucggacugcagacgucuuccaucgaaggcgccugggguagcggggucggauuuacccuuacuuguuuggugucgcucacagagugccccaccuuccugacaucaauuaaggcaugcgacaaagccaucuguuacggcgcugagucuguuacucuaacccggggucagaacacggugaaggucaguggcaaggguggacacuccggcagcacauuuaaaugcugucauggggaagauugcucucagauuggacugcacgccgcagcuccacaucucgacaaggugaauggcauaagcgagauggaaaacuccaaaguuuaugaugacggugccccgcaaugugggaucaagugcugguucgugaaaucaggagaguggauuaguggcaucuuuagcgguaauuggauuguccugaucguacuuuguguguucuugcuguucucuuuaguucuccuguccauacuuugcccugugcgaaagcacaagaaaucauga

SEQ ID NO: 10043 - RNA, 3408 nt, Artificial Sequence
  derived and/or modified CDS sequence (opt3) from HTNV(Aa10-561)__KT935006.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaauuaguuuugagacuguguccaccgaagucgaccucaagggcacaugcgugcugaaacacaagaugguagaggagucuuaucggagccgcaaguccaucaccuguuacgaucuuucaugcaacaguacuuauuguaaaccaacacuguacaugauuguucccauccaugcgugcaauaugaugaaaagcuguuugauagcucucgggccuuaucgagugcaggucguguacgaacguaccuacugcaugacgggagugcugaucgagggcaaauguuucgucccagaccagucuguuguguccauuaucaagcacgguauuuuugauaucgccucaguacauauagugugcuucuuugucgcagugaaagggaacacuuauaagauuuucgaacagguuaagaaaaguuuugagaguaccuguaaugacacagagaacaaggugcaaggauacuauaucugcauugucggcggcaauucugcccccaucuacgugccuacucuggaugacuucagauccauggaagcauuuaccgggaucuucaggagcccacacggagaggaucacgaccucgcuggugaagagacagccaccuauucgauuguaggcccggcuaacgccaaaguuccccauucugcguccucagauacguuaagucugauagcauuuagcgggaucccuuccuacucuagccuuucaauuuugacuagcuccacagaagccaagcacguguucagcccaggacuguuucccaaacuaaaucauaccaacugcgacaagggcgcuaucccucucauguggacugguaugauagaccugccaggguauuacgaggccauucaccccuguacagucuucugcgugcuuucuggaccgggcgcaucaugugaggcuuucagugaaggcgggaucuuuaauaucaccagcccuaugugccuggucuccaaacagaaccgguuccgcuugacggagcaacaggugaauuuuguuugucaaagaguggauguagacauugucguguacugcaacggacagaggaagguuauccucaccaagacacuggugauuggucaguguauauauacuaucaccucuuuauucucgcugcuccccggcgucgcccacagcauugcgguggaacuuugcguaccaggguuucauggaugggccacagcagcucuguuggugacuuucuguuuuggcuggguucuaaucccugccaucaccuucauuauacugacaauccucaaauuuauugcuaacaucuuccacaccuccaaucaagagaaccggcugaagucaguccuucgcaaaauuaaggaagaguuugagaaaacuaaggguaguauggugugcgauguguguaaguacgaaugcgagacguauaaagaacugaaggcccauggggucucuugcccccagagccaguguccauacugcuucacacacugugagcccaccgaagcagccuuucaggcucauuauaaaguuugccaagugacucaccgauucagagacgauuugaagaaaaccgugacaccucagaauuucaccccaggcuguuacaggacucucaaccuguuucgguauaagucccguugcuacaucuucacaauguggauauuuuuacugguacuagagucaauccucugggcggcaagcgccucugagacgccgcugacccccgucuggaaugacaacgcucacggagugggcuccguuccuaugcauacugaucuugaauuggacuucagucugacaucuagcuccaaguacaccuaucgcagaaaacucacaaauccacuggaggaagcccagucaauugaucuucacaucgagauugaggaacagacuaucgggguggacguccaugcacugggacacugguuugaugguagguugaaccucaagaccaguuuccacuguuacggcgccugcacgaaauaugaguaccccuggcauaccgcuaagugucacuaugaacgggacuaccaauaugagacaagcugggggugcaauccuucggacuguccaggagugggcacugguugcaccgccugcgggcuguacuuagaucgacugaaacccguuggcuccgcauacaagauaauuacaauccgcuauucuagaaggguguguguacaguuuggagaagagaaccuaugcaagauuaucgacaugaaugauuguuucgucagccggcaugugaaagugugcauaaucggcacuauuucaaaguuuagucagggggacacccuccuguucuuuggaccgcuugaggguggcggguugaucuucaaacacugguguacguccacaugccaguuuggagauccuggcgacauuaugucuccacgcgauaaggguuuccugugucccgaguucccugggagcuuuagaaagaagugcaacuucgcgaccacucccaucugugaguacgacggcaauauggucuccggauauaaaaagguuauggcuacaauagauucauuucagagcuucaacaccaguacuaugcauuuuaccgacgaaaggauugaguggaaggauccagacggcaugcuccgugaucacaucaauauccuggugacaaaagacauugacuucgauaacuuaggggaaaacccuugcaagaucggacugcaggccucuuccauugagggcgcaugggguagcgggguaggauuuacgcuuaccuguuuggugucgcucacugagugccccacauuccugaccucaauaaaagccugcgacaaggcuaucuguuacggcgccgaaucugucacacuaacucggggucagaauaccgugaaaguuaguggcaaagggggacacuccggcagcacguuuaagugcugucauggggaggauugcucucagauuggacugcacgcagcugccccacaucucgacaaggugaacggcaucagcgaaauggaaaauuccaaggucuaugaugacggugcgccgcaaugugggauuaaaugcugguucgugaagucaggagaauggaucaguggcauauuuagcgguaacuggaucguucugauugugcuuugugucuucuugcuguucucuuuaguacuccuguccauccuuugcccugugcgaaaacacaagaagucauga

SEQ ID NO: 10044 - RNA, 3408 nt, Artificial Sequence
  derived and/or modified CDS sequence (opt3) from HTNV(Aa14-172)__KT935008.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuaacugauacggcucagcuggugccugaaucaaguuguagcauggacaaccaucaaucccuaaauaccaucacaaaguacacucagguuucuuggagggguaaagcagaucagucgcagucaagccaaaacaguuuugagaccguguccacagaagucgaccucaagggcacuugcgugcugaaacacaagaugauugaggagucuuaucggagccgcaaguccaucacuuguuacgaucuuucaugcaauaacacauauuguaaaccaacccuguacaugauuguacccauccaugccugcaauaugaugaagaguuguuugauagcgcucgggccuuaucgaguucagguggucuacgaacguacguacugcaugacuggagugcugaucgagggcaaauguuucgugccagaccagagcgucguuucuauuaucaagcacgguauuuuugauaucgcuuccgugcauauaguaugcuucuuuguggccgucaaagggaacaccuauaagauuuucgaacaggugaagaaaucauuugagagcacauguaaugacacugagaacaagguucaaggauacuauaucugcauugugggcggcaauagugcacccaucuacgucccuacccuggaugacuucagaucuauggaagccuuuacagggaucuucagguccccacacggagaggaucacgaccucgcuggugaagagaccgcaacguauagcauugugggcccggccaacgcuaaaguaccccauucggccucuuccgauacuuuaucacugauagcguuuagugggaucccuagcuacuccucucuuagcauuuugacaucaaguaccgaagcaaagcacguuuucuccccaggacuguuucccaaacuaaaucauacuaacugcgacaagggcgccaucccucucauguggacagguaugauagaccugccaggguauuacgaggcuauucaccccuguaccguguucugcguccuuagcggaccgggcgccucuugugaggcauucucagaaggcgggaucuuuaauaucacgaguccuaugugccuggugagcaaacagaaccgguuccgcuugaccgagcagcaggucaacuuugugugucaaagaguugauguggacauuguagucuacugcaauggacagaggaaggugauccucacaaagacucugguuauuggucaguguauauauaccaucacauccuuauucucucugcuccccggcguggcucacucgauugccgucgaacuuugcgugccaggguuucauggaugggcgacugccgcacuguugguaaccuucuguuuuggcugggugcuaaucccugcuaucacauucauuauacugaccauccucaaauuuauugccaacaucuuccacacuagcaaucaagagaaccggcugaaguccguucuucgcaaaauuaaggaagaguuugagaaaacgaaggguucaauggucugcgauguguguaaguacgaaugcgagacauauaaagaacugaaggcucauggggugaguugcccccagucucaguguccauacugcuucacccacugugagcccacugaagccgcauuucaggcccauuauaaagucugccaaguuacccaccgauucagagacgauuugaagaaaacagugaccccucagaauuucacuccaggcuguuacaggacacucaaccuguuucgguauaagagccguugcuacaucuucacgauguggauauuuuuacuggugcuagaguccauccucugggcugcgucagcaagcgagaccccgcugacucccguauggaaugacaacgcccacggagucggcucugugccuaugcauacagaucuugaauuggacuucucccugaccaguagcucuaaguacacauaucgcagaaaacucacuaauccacuggaggaagcucaguccauugaucuucacaucgagauugaggaacagaccaucgggguugacgugcaugcccugggacacugguuugaugguagguugaaccucaagacgucauuccacuguuacggcgcaugcaccaaauaugaguaccccuggcauacagccaagugucacuaugaacgggacuaccaauaugagaccaguugggggugcaauccuagcgacuguccaggagucggcaccgguugcacagcuugcgggcuguacuuagaucgacugaaacccgugggcucggccuacaagauaauuacuauccgcuauuccagaaggguuugugugcaguuuggagaagagaaccuaugcaagauuaucgacaugaaugauuguuucguaucucggcaugucaaagugugcauaaucggcaccgugagcaaguuuucacagggggacacgcuccuguucuuuggaccgcuugaggguggcggguugauuuucaaacacugguguacaaguaccugccaguuuggagauccuggcgacaucauguccccacgcgauaaggguuuccugugucccgaguucccugggucuuuuagaaagaagugcaacuucgcaacuacacccauuugugaauacgacggcaauauggucagcggauauaaaaagguuauggcgaccaucgauuccuuucaaucauucaacacuagcaccaugcauuuuacagacgaaaggauagaguggaaggauccagacggcaugcuccgugaucacauuaacauccuggugacgaaagacaucgacuucgauaauuuaggggaaaacccuugcaagauuggacugcagaccaguucuaucgagggcgcuugggguuccgggguaggauuuacucuuacauguuuggugagccucaccgagugccccacauuccugacuucgauuaaagccugcgacaaggcaauauguuacggcgccgaaucagucacccuaacgcggggucagaauacagugaaaguuucuggcaaagggggacacaguggcuccaccuuuaagugcugucauggggaggauugcagccagaucggacugcacgcugccgcaccacaucucgacaaagugaacggcauuucugaagucgagaauagcaagguguaugaugacggugcuccgcaaugugggaucaaaugcugguucguuaaguccggagaauggauuucaggcaucuuuagugguaacuggauagugcugaucguccuuuguguauucuugcuguucagcuuagugcuccugucuauucuuugcccuguucgaaaacacaagaaguccuga

SEQ ID NO: 10045 - RNA, 3408 nt, Artificial Sequence
  derived and/or modified CDS sequence (opt3) from HTNV(Aa14-266)__KT935013.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagauggugccugaaucaaguuguagcauggacaaccaucaaucccugaauacgaucaccaaguacacacagguuucuuggagggguaaagccgaucagucgcagucaaaccaaaauagcuuugagacugugaguaccgaagucgaccuaaagggcacaugcgugcucaaacacaagaugguagaggaguccuaucggucucgcaagagcauuaccuguuacgaucuguccugcaacucaacuuauuguaaaccaacacuuuacaugaucguucccauucaugcgugcaauaugaugaagaguugucugaucgcuuuggggccuuaucgagugcaggucguguacgaacguaccuacugcaugacgggagugcucauagagggcaaauguuucgucccagaccagagcguugugucuaucauuaagcacgguaucuuugauauugccuccguacauaucgugugcuucuuugucgcagugaaagggaacacuuauaagauauucgaacagguuaagaaaucauuugagagcaccuguaaugacacagagaacaaggugcaaggauacuauauuugcaucgucggcggcaauagugcccccauuuacgugccuacucuggaugacuucagaucuauggaggcuuuuaccgggaucuucagguccccacacggagaggaucacgaccuggcuggugaagagaucgccacauauagcauuguaggcccggcuaacgccaaaguuccccauucggcgucuuccgauacccucucauuaauagcauacagugggaucccuagcuauuccucucugagcauucuuacgucaaguacugaagccaagcacguguuuuccccaggauuguuccccaaacugaaucauacaaacugcgacaagagcgcuaucccucuaauguggaccggcaugauagaccucccagguuacuacgaggccguccaccccuguacuguguuuugcguccugucugggccgggagcaucaugugaggcuuucagugaaggcggcauuuucaauaucacaagcccuaugugccuuguguccaaacagaaccgguuucgccugaccgagcagcagguuaacuucgugugucaaagaguagaugucgacaucgugguuuauugcaaugggcagaggaaggugauuuugacgaagacccucgucaucggacaguguauuuacacaauaacuucucuguuuucguuacugcccgguguggcccacagcaucgcgguagaacucugcgugccaggcuuccaugggugggccaccgcagcacuucugguuacauuuuguuucggaugggucuugauuccugccaucacuuuuaucauucuaaccauacugaaauucaucgcuaacauuuuucacacauccaaucaagagaaccggcucaagucagugcugcgcaaaaucaaggaagaguucgagaaaaccaagggcaguauggugugcgaugucuguaaguaugaaugcgagacuuacaaagaacuuaaggcccaugguguuucuugcccccagagccaguguccauauugcuuuacgcacugugagcccacagaagcagccuuccaggcucauuacaaagugugccaagugacccaccgauuuagagacgaucugaagaaaacuguaaccccucagaauuucacaccaggguguuauaggaccuugaaccucuuccgguacaagucccguugcuacauuuuuacuauguggaucuuccuguuaguccuggagucaauacuaugggcggcaagcgccucugagacaccgcucacgcccguguggaaugacaacgcucacggcguuggauccgugccuaugcauaccgaucuggaacuugacuuuaguuugacuagcaguuccaaguauacauaccgcagaaaacugaccaauccacucgaggaagcccagucaaucgaucugcacauugagaucgaggaacagacaauuggcgucgacgugcaugcacuugggcacugguucgauggaaggcugaacuugaagacuucuuuucacuguuauggugccugcaccaaauacgaguaucccuggcauacggcuaagugucacuacgaacgggacuaucaauacgagaccagcuggggcugcaauccuucggacuguccagggguuggaacaggcugcacugccugcggucucuaccuggaucaguuaaaacccgugggguccgcauauaagaucauaaccauucgauacucucgcagaguauguguccaguucggcgaagagaaccugugcaagacaaucgacaugaaugauuguuuugugagcaggcaugugaaagucugcauuaucggaacuguuucaaaguucagucagggcgacacccuacucuuuuucgggccgcuggagggagguggccuuauauuuaaacacugguguacguccacaugccaauucggggauccuggagacaucaugucuccacgggauaagggcuuuuugugucccgaguucccugguagcuuccgcaaaaagugcaacuuugcgaccacucccauuugugaauaugacgggaauaugguguccggcuacaaaaagguaauggcuacaaucgauucauuccagagcuuuaacaccaguacuaugcauuucaccgacgaaagaauugaguggaaggauccagacggaaugcugagggaucacaucaacauacucgugacaaaagacauugacuuugauaaucugggcgaaaacccuugcaagaucggguuacagacgucuuccaucgagggagccuggggcagcggugucggguucacccugacuugucuugugucguugacagagugccccaccuuucucacaucaauuaaagcaugcgacaaggccaucuguuauggagcugaaucuguuacucugacccguggccagaauacggugaaagucagugguaagggcgggcacuccggaagcacauucaagugcugucauggcgaggauugcucucaaauugggcuacacgccgcagcuccacaucuggacaaagugaacggaauaagcgaaauggaaaauuccaagguuuacgaugacggcgccccgcagugugguaucaaaugcugguuugugaagucaggggaauggauuaguggaaucuucagcggcaacuggauuguccucaucguacuguguguguuucuuuuguucucucugguuuuacucuccauacugugcccugugcggaaacacaagaagucauga

SEQ ID NO: 10046 - RNA, 3408 nt, Artificial Sequence
  derived and/or modified CDS sequence (opt3) from HTNV(Aa14-272)__KT935014.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagauggugccugaaucaaguuguagcauggacaaccaucaaucccugaauacgaucaccaaguacacacagguuucuuggagggguaaagccgaucagucgcagucaaaccaaaauagcuuugagacugugaguaccgaagucgaccuaaagggcacaugcgugcucaaacacaagaugguagaggaguccuaucggucucgcaagagcauuaccuguuacgaucuguccugcaacucaacuuauuguaaaccaacacuuuacaugaucguucccauucaugcgugcaauaugaugaagaguugucugaucgcuuuggggccuuaucgagugcaggucguguacgaacguaccuacugcaugacgggagugcucauagagggcaaauguuucgucccagaccagagcguugugucuaucauuaagcacgguaucuuugauauugccuccguacauaucgugugcuucuuugucgcagugaaagggaacacuuauaagauauucgaacagguuaagaaaucauuugagagcaccuguaaugacacagagaacaaggugcaaggauacuauauuugcaucgucggcggcaauagugcccccauuuacgugccuacucuggaugacuucagaucuauggaggcuuuuaccgggaucuucagguccccacacggagaggaucacgaccuggcuggugaagagaucgccacauauagcauuguaggcccggcuaacgccaaaguuccccauucggcgucuuccgauacccucucauuaauagcauacagugggaucccuagcuauuccucucugagcauucuuacgucaaguacugaagccaagcacguguuuuccccaggauuguuccccaaacugaaucauacaaacugcgacaagagcgcuaucccucuaauguggaccggcaugauagaccucccagguuacuacgaggccguccaccccuguacuguguuuugcguccugucugggccgggagcaucaugugaggcuuucagugaaggcggcauuuucaauaucacaagcccuaugugccuuguguccaaacagaaccgguuucgccugaccgagcagcagguuaacuucgugugucaaagaguagaugucgacaucgugguuuauugcaaugggcagaggaaggugauuuugacgaagacccucgucaucggacaguguauuuacacaauaacuucucuguuuucguuacugcccgguguggcccacagcaucgcgguagaacucugcgugccaggcuuccaugggugggccaccgcagcacuucugguuacauuuuguuucggaugggucuugauuccugccaucacuuuuaucauucuaaccauacugaaauucaucgcuaacauuuuucacacauccaaucaagagaaccggcucaagucagugcugcgcaaaaucaaggaagaguucgagaaaaccaagggcaguauggugugcgaugucuguaaguaugaaugcgagacuuacaaagaacuuaaggcccaugguguuucuugcccccagagccaguguccauauugcuuuacgcacugugagcccacagaagcagccuuccaggcucauuacaaagugugccaagugacccaccgauuuagagacgaucugaagaaaacuguaaccccucagaauuucacaccaggguguuauaggaccuugaaccucuuccgguacaagucccguugcuacauuuuuacuauguggaucuuccuguuaguccuggagucaauacuaugggcggcaagcgccucugagacaccgcucacgcccguguggaaugacaacgcucacggcguuggauccgugccuaugcauaccgaucuggaacuugacuuuaguuugacuagcaguuccaaguauacauaccgcagaaaacugaccaauccacucgaggaagcccagucaaucgaucugcacauugagaucgaggaacagacaauuggcgucgacgugcaugcacuugggcacugguucgauggaaggcugaacuugaagacuucuuuucacuguuauggugccugcaccaaauacgaguaucccuggcauacggcuaagugucacuacgaacgggacuaucaauacgagaccagcuggggcugcaauccuucggacuguccagggguuggaacaggcugcacugccugcggucucuaccuggaucaguuaaaacccgugggguccgcauauaagaucauaaccauucgauacucucgcagaguauguguccaguucggcgaagagaaccugugcaagaucauugacaugaaugauuguuuugugagcaggcaugugaaagucugcaucauaggaacaguuucaaaguucagucagggcgacacucuacucuuuuucgggccgcuggagggagguggccuuaucuuuaaacacugguguaccuccacgugccaauucggggauccuggagacauuaugucuccacgggauaagggcuuuuugugucccgaguucccugguagcuuccgcaaaaagugcaacuuugcgacaacccccaucugugaauaugacgggaauaugguguccggcuacaaaaagguaauggcuacuauugauucauuccagagcuuuaacacaaguaccaugcauuucacugacgaaagaaucgaguggaaggauccagacggaaugcugagggaucacauaaacauucucgugaccaaagacaucgacuuugauaaucugggcgaaaacccuugcaagaucggguuacagacaucuuccauugagggagccuggggcagcggugucggguucacgcugaccugucuugugucguugacugagugccccacauuucucaccucaaucaaagcaugcgacaaggccauuuguuauggagcugaaucuguuacacugacucguggccagaauaccgugaaagucagugguaagggcgggcacuccggaagcacguucaagugcugucauggcgaggauugcucucaaauagggcuacacgccgcagcuccacaucuggacaaagugaacggaaucagcgaaauggaaaauuccaagguuuacgaugacggcgccccgcagugugguauuaaaugcugguuugugaagucaggggaauggaucaguggaauuuucagcggcaacuggaucguccucauaguacuguguguguuucuuuuguucucucugguuuuacucuccauccugugcccugugcggaaacacaagaagucauga

SEQ ID NO: 10047 - RNA, 3408 nt, Artificial Sequence
  derived and/or modified CDS sequence (opt3) from HTNV(Aa14-362)__KT935015.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugaggcgguguccacugaagucgaccucaaggggaccugcgugcugaaacacaagaugguagaggagucuuaucggagccgcaaguccauuacauguuacgaucuuucaugcaauaguaccuauuguaaaccaacucuguacaugaucguucccauucaugcuugcaacaugaugaaaagcuguuugaucgcccucgggccuuaucgagugcaggucguguacgaacguacauacugcaugaccggagugcugauagagggcaaauguuucgucccagaccagucuguuguguccaucauuaagcacgguaucuuugauauugcaucaguacauaucgugugcuucuuugucgccgugaaagggaauacguauaagauauucgaacagguuaagaaaaguuuugagaguacuuguaacgacaccgagaauaaggugcaaggauacuauauuugcaucgucggcggcaacucugcucccauuuacgugccuacacuggaugacuucagauccauggaagcauuuacugggaucuucaggagcccacacggagaggaucacgaccucgccggugaagagaccgcuacauauucgaucguaggcccggccaaugcgaaaguuccccauucugcauccucagauaccuuaagucugauugccuuuagcgggauaccuuccuacucuagccuuucaaucuugacgaguuccacugaagcuaagcacguguucagcccaggacuguuucccaaacuaaaccauacaaauugcgacaagggcgccauuccucucauguggaccgguaugaucgaccugccaggguauuacgaggcaauacaccccuguacugucuucugcgugcuuucuggaccgggcgcuucaugugaggccuucagugaaggcgggauuuuuaacaucacaagcccuaugugccuggucuccaaacagaaucgguuccgcuugaccgagcaacaggugaacuuuguuugucaaagaguggauguagacaucauugucuacugcaacggacagaggaaggugauccucacgaagacccugguuauuggucaguguauauauacaaucacuucuuuauucucgcugcuccccggcguggcgcacagcauugccgucgaacuuugcgugccaggguuucauggaugggcaaccgcugcccuguugguaacauucuguuuuggcugggugcuaaucccugcuaucacuuucauuauacugaccauccucaaauuuauugccaauaucuuccacacauccaaccaagagaaucggcugaagucaguucuucgcaaaauuaaggaagaguuugagaaaaccaaggguaguauggucugcgauguguguaaguacgaaugcgagacuuauaaagaacugaaggcacauggggugucuugcccccagagccaguguccauacugcuucacgcacugugagcccacagaagccgcuuuucaggcgcauuauaaagucugccaaguuacccaccgauucagagacgauuugaagaaaacugugaccccucagaacuucacaccaggcuguuacaggacccucaaucuguuucgguauaagucccguugcuacaucuucacuauguggauauuuuuacuggugcuagagucaauccucugggcagccagcgcuucugagacaccgcugacgcccguauggaacgacaaugcccacggagucggcuccgugccuaugcauaccgaucuugaauuggacuucagucugacuucuagcuccaaguacacauaucgcagaaaacucaccaacccacuggaggaagcacagucaauugaucuucacaucgagauugaggaacagacaaucgggguugacgugcaugcccugggacacugguuugaugguagguugaaucucaagacuagcuuccacuguuacggcgcuugcaccaaauaugaguaccccuggcauacggccaagugucacuaugaacgggacuaccaauaugagaccagcugggggugcaacccuucggacuguccaggagucggcacagguugcacugcaugcgggcuguacuuagaucgacugaaacccgugggcuccgcguacaagauaauuaccauccgcuauucuagaaggguuugugugcaguuuggagaagagaaucuaugcaagauuaucgacaugaacgauuguuucguaagccggcaugucaaagugugcauaaucggcacagugucaaaguuuagucagggggacacucuccuguucuuuggaccgcuugaggguggcggguugauuuucaaacacugguguaccuccacgugccaguuuggagauccuggcgacaucaugucuccacgcgauaaggguuuccugugucccgaguucccugggagcuuuagaaagaagugcaauuucgcuacaacccccauuugugaauacgacggcaacauggucuccggauauaaaaagguuauggccacuaucgauucauuucagagcuucaauacaaguaccaugcauuuuacugacgaaaggauagaguggaaggauccagacggcaugcuccgugaucacauuaacauccuggugaccaaagacaucgacuucgauaacuuaggggaaaauccuugcaagauuggacugcagacaucuuccaucgagggcgcaugggguagcgggguaggauuuacgcuuaccuguuuggugucgcucacugagugccccacauuccugaccucaauuaaagccugcgacaaggcuauauguuacggcgccgaaucugucacacuaacucggggucagaacaccgugaaaguuaguggcaagggcggacacuccggcagcacguuuaagugcugucauggggaggauugcucucagaucggacugcacgcagcugccccacaucucgacaaagugaauggcauuagcgaaauggagaacuccaaggucuaugaugacggugcgccgcaaugugggaucaaaugcugguucgugaagucaggagaauggauuaguggcaucuuuagcgguaauuggauaguucugaucgugcuuugugucuucuugcuguucucuuuaguacuccuguccauucuuugcccugugcgaaaacacaagaagucauga

SEQ ID NO: 10048 - RNA, 3408 nt, Artificial Sequence
  derived and/or modified CDS sequence (opt3) from HTNV(Aa14-404)__KT935018.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagauggugccugaaucaaguuguagcauggacaaccaucaaucccugaauacgaucaccaaguacacacagguuucuuggagggguaaagccgaucagucgcagucaagccaaaacaguuuugagacuguguccaccgaagucgaccuaaagggcacaugcgugcucaaacacaagaugguagaggagucuuaucggagccgcaaguccauuaccuguuacgaucugucaugcaauaguacuuauuguaaaccaacacuuuacaugaucguucccauucaugcgugcaacaugaugaaaagcugucugaucgcuuuggggccuuaucgagugcaggucguguacgaacguaccuacugcaugacgggagugcucauagagggcaaguguuucgucccagaccagucuguuguguccaucauuaagcacgguaucuuugauauugccucaguacauaucgugugcuucuuugucgcagugaaagggaauacuuauaagauauucgaacagguuaagaaaaguuuugagagcaccuguaacgacacagagaauaaggugcaaggauacuauauuugcaucgucggcggcaacucugcccccauuuacgugccuacucuggaugacuucagauccauggaggcuuuuaccgggaucuucaggagcccacacggagaagaucacgaccuggcuggugaagagaucgccacauauucgauuguaggcccggcuaaugccaaaguuccccauucugcguccucagauacccucaguuuaauagcauacagcgggaucccuuccuauucuagccugucaauucuuacgaguuccacugaagccaagcacguguuuagcccaggauuguuccccaaacugaaccauacaaauugcgacaagucugcuaucccucuaauguggaccggcaugauagaccucccagguuacuacgaggccguccaccccuguacuguguuuugcguccugucagggccgggagcaaguugugaggcuuucagcgaaggcggcauuuucaacaucacauccccuaugugccuugugucuaaacagaaucgguuucgccugaccgagcagcagguuaacuucgugugucaaagaguagaugucgacaucgugguuuauugcaacgggcagaggaaggugauuuugacgaagacccucgucaucggacaguguauuuacacaauaacuucgcuguuuagcuuacugcccgguguggcccacuccaucgcgguagaacucugcgugccaggcuuccaugggugggccaccgcagcacuucugguuacauuuuguuucggaugggucuugauuccugccaucacuuuuaucauucuaaccauacugaaauucaucgcuaauauuuuucacacaucaaaccaagagaaucggcucaagagugugcugcgcaaaaucaaggaagaguucgagaaaaccaagggcucuauggugugcgaugucuguaaguaugaaugcgagacuuacaaagaacuuaaggcccaugguguuagcugcccccagucccaguguccauauugcuuuacgcacugugagcccacagaagcaaccuuccaggcccauuacaaagugugccaagugacucaccgauuuagagacgaucugaagaaaaccguaacaccucagaacuucaccccaggguguuauaggacuuugaaucucuuccgguacaagucacguugcuacauuuuuacaauguggaucuuccuguuaguccuggagagcauacuaugggcugcgucugcauccgagacgccgcucacccccguguggaacgacaaugcccacggcguuggaagugugccuaugcauacugaucuggaacuugacuuuagcuugacaucuuccucaaaguauaccuaccgcagaaaacugacaaacccacucgaggaagcucagaguaucgaucugcacauugagaucgaggaacagacuauuggcgucgacgugcaugcccuugggcacugguucgauggaaggcugaauuugaagaccagcuuucacuguuauggugcaugcacgaaauacgaguaucccuggcauaccgccaagugucacuacgaacgggacuaucaauacgagacaucguggggcugcaacccuuccgacuguccagggguuggaacuggcugcaccgcuugcggucucuaccuggaucaguuaaaacccguggggucugccuauaagaucauaacaauucgauacagccgcagaguauguguccaguucggcgaagagaaucugugcaagaucauugacaugaacgauuguuuugugucaaggcaugugaaagucugcaucauaggaacuguuaguaaguucucccagggcgacacccuacucuuuuucgggccgcuggagggagguggccuuaucuuuaaacacugguguacgucuacaugccaauucggggauccuggagacauuaugagcccacgggauaagggcuuuuugugucccgaguucccugguuccuuccgcaaaaagugcaauuuugcaaccacuccccugugugaauaugacgggaacauggugucaggcuacaaaaagguaauggcgacaaucgauagcuuccagaguuuuaauaccucuacuaugcauuucaccgacgaaagaauugaguggaaggauccagacggaaugcucagggaucacaucaacauacuggugacaaaagacauugacuuugauaacuuaggcgaaaauccuugcaagaucgggcugcagacguccagcaucgagggagcuuggggcucgggugucggguucacccuuacuuguuuggugucacucacagagugccccaccuuucugacaucuauuaaagccugcgacaaggcaaucuguuauggagccgaaaguguuacucuaacccguggccagaacacggugaaagucuccgguaagggcgggcacagcggaucuacauucaagugcugucauggcgaggauugcagccaaauugggcugcacgcugccgcaccacaucucgacaaagugaauggaauauccgaaauggagaacucaaagguuuacgaugacggcgcuccgcagugugguaucaaaugcugguuugugaagaguggggaauggauuagcggaaucuucucuggcaauuggauuguccugaucguacuuuguguguuuuugcuguucuccuuaguucuccugucaauacuuugcccugugcggaaacacaagaagaguuga

SEQ ID NO: 10049 - RNA, 3408 nt, Artificial Sequence
  derived and/or modified CDS sequence (opt3) from HTNV(Aa14-423)__KT935022.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagauggugccugaaucaaguuguagcauggacaaccaucaaucccugaauacgaucaccaaguacacacagguuucuuggagggguaaagccgaucagucgcagucaagccaaaacaguuuugagacuguguccaccgaagucgaccuaaagggcacaugcgugcucaaacacaagaugguagaggagucuuaucggagccgcaaguccauuaccuguuacgaucugucaugcaauaguacuuauuguaaaccaacacuuuacaugaucguucccauucaugcgugcaacaugaugaaaagcugucugaucgcuuuggggccuuaucgagugcaggucguguacgaacguaccuacugcaugacgggagugcucauagagggcaaguguuucgucccagaccagucuguuguguccaucauuaagcacgguaucuuugauauugccucaguacauaucgugugcuucuuugucgcagugaaagggaauacuuauaagauauucgaacagguuaagaaaaguuuugagagcaccuguaacgacacagagaauaaggugcaaggauacuauauuugcaucgucggcggcaacucugcccccauuuacgugccuacucuggaugacuucagauccauggaggcuuuuaccgggaucuucaggagcccacacggagaagaucacgaccuggcuggugaagagaucgccacauauucgauuguaggcccggcuaaugccaaaguuccccauucugcguccucagauacccucaguuuaauagcauacagcgggaucccuuccuauucuagccugucaauucuuacgaguuccacugaagccaagcacguguuuagcccaggauuguuccccaaacugaaccauacaaauugcgacaagucugcuaucccucuaauguggaccggcaugauagaccucccagguuacuacgaggccguccaccccuguacuguguuuugcguccugucagggccgggagcaaguugugaggcuuucagcgaaggcggcauuuucaacaucacauccccuaugugccuugugucuaaacagaaucgguuucgccugaccgagcagcagguuaacuucgugugucaaagaguagaugucgacaucgugguuuauugcaacgggcagaggaaggugauuuugacgaagacccucgucaucggacaguguauuuacacaauaacuucgcuguuuagcuuacugcccgguguggcccacuccaucgcgguagaacucugcgugccaggcuuccaugggugggccaccgcagcacuucugguuacauuuuguuucggaugggucuugauuccugccaucacucuaaucauucugaccauacucaaauuuaucgcuaauauuuuccacacaucaaaccaagagaaucggcugaagagugugcuucgcaaaaucaaggaagaguuugagaaaaccaagggcucuauggugugcgaugucuguaaguaugaaugcgagacuuacaaagaacugaaggcccaugguguuagcugcccccagucccaguguccauauugcuucacgcacugugagcccacagaagcaaccuuucaggcccauuacaaagugugccaagugacucaccgauucagagacgauuugaagaaaaccguaacaccucagaacuuuaccccaggguguuauaggacucucaaucuguuccgguacaagucacguugcuacauuuucacaauguggaucuuuuuacugguccuagagagcauacucugggcugcgucugcauccgagacgccgcugacccccguguggaacgacaaugcccacggcguuggaagugugccuaugcauacugaucuugaauuggacuucagccugacaucuuccucaaaguauaccuaccgcagaaaacucacaaacccacuggaggaagcucagaguaucgaucuucacauugagaucgaggaacagacuauuggcgucgacgugcaugcccuggggcacugguuugauggaagguugaaucucaagaccagcuuccacuguuauggugcaugcacgaaauacgaguaucccuggcauaccgccaagugucacuacgaacgggacuaucaauacgagacaucguggggcugcaacccuuccgacuguccagggguuggaacuggcugcaccgcuugcggucuguacuuagaucagcugaaacccguggggucugccuauaagaucauaacaauucgauacagccgcagaguauguguccaguuuggcgaagagaaucuaugcaagaucauugacaugaacgauuguuucgugucaaggcaugugaaagucugcaucauaggaacuguuaguaaguuuucccagggcgacacccuccuguucuuugggccgcuugagggagguggcuugaucuucaaacacugguguacgucuacaugccaauuuggggauccuggagacauuaugagcccacgggauaagggcuuccugugucccgaauuuccugguuccuuccgcaaaaagugcaauuucgcaaccacuccccucugugaguaugacgggaacauggugucaggcuacaaaaagguaauggcgacaaucgauagcuuucagaguuucaauaccucuacuaugcauuuuaccgacgaaagaauugaguggaaggauccagacggaaugcugagggaucacaucaacauauuagugacaaaagacauugacuucgauaaccugggcgaaaauccuugcaagaucgggcuucagacguccagcaucgagggagcuuggggcucgggugucggguuuaccuugacuugucucgugucacugacagagugccccaccuuccuaacaucuauuaaagccugcgacaaggcaaucuguuauggagccgaaaguguuacucugacccguggccagaacacggugaaagucuccgguaagggcgggcacagcggaucuacauuuaagugcugucauggcgaggauugcagccaaauugggcuccacgcugccgcaccacaucuggacaaagugaauggaauauccgaaauggagaacucaaagguuuacgaugacggcgcuccgcagugugguaucaaaugcugguucgugaagaguggggaauggauuagcggaaucuuuucuggcaauuggauuguccuuaucguauuguguguguuccuguuauuuucccucguucugcuuucaauacugugcccugugcggaaacacaagaagaguuga

SEQ ID NO: 10050 - RNA, 3408 nt, Artificial Sequence
  derived and/or modified CDS sequence (opt3) from HTNV(Aa15-56)__KU207187.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggaggcggaaagccgaucagucgcagucaagccaaaacaguuuugagacuguguccaccgaagucgaccucaaggguacaugcgugcugaaacacaagaugguagaggagucuuaucgcagccgaaaguccauuaccuguuacgaucuuucaugcaauaguacuuauuguaaaccaacacuguacaugaucguucccauucaugcgugcaacaugaugaaaagcuguuugaucgcucucggcccuuaucgugugcaggucguguacgaaagaaccuacugcaugacgggggcccugauagagggaaaguguuucgugccagaccagucugucguuuccaucauuaagcacggcaucuuugauauugcaucagugcauaucguaugcuucuuuguggccgucaaagguaauacuuauaagauauucgaacaggugaagaaaaguuuugagaguaccuguaacgacacagagaauaagguucaaggguacuauauuugcaucgugggaggcaacucugcucccauuuacgucccuacucuggaugacuucagguccauggaagcauuuaccggcaucuuccggagcccacacggggaggaucacgaccucgccggagaagagacagcuaccuauucgaucguggguccggccaaugcgaaaguaccccauucugcauccucagauacguuaagucugauugccuuuagcggcauaccuuccuacucuagccuuucaaucuugacuagcuccacagaagcuaagcacguuuucagcccagggcuguuucccaaacuaaaccauaccaauugcgacaagggagccauuccucucauguggacuggcaugaucgaccugccagguuauuacgaggcaauacaccccuguacaguguucugcguccuuucugggccgggagcuucaugugaggccuucagugaaggcggcauuuuuaacaucaccagcccuaugugccugguguccaaacagaaucgcuucagauugacggagcagcaggucaacuuugugugucaaaggguugauguggacaucguagucuacugcaacgggcagcggaaggugauucucaccaagacacugguuaucggacaguguauuuauacuauaaccucuuuauucucgcugcuccccgguguggcgcacagcaucgccgucgaacuuugcgugccaggcuuucaugggugggcaacagcugcccuguugguaacuuucuguuuuggaugggugcuaauuccugcuaucaccuucaucauucugacaauacucaaauuuaucgccaauauuuuccacaccuccaaccaagagaaucgccugaagucaguucuucgaaaaaucaaggaagaguuugagaaaacuaagggcaguauggucugcgauguguguaaguacgaaugcgagacguauaaagaacugaaggcacauggugugucuugcccccagagccaguguccauacugcuucacacacugugagcccaccgaagccgcuuuucaggcgcauuauaaagucugccaaguuacucacagauucagggacgauuugaagaaaaccgugacaccucagaacuucaccccaggguguuaccggacucucaaucuguuucguuauaagucccgcugcuacauuuucacaauguggaucuuuuuacuggugcuagagucaauacucugggcagccagcgcuucugagacgccgcugacccccguauggaacgacaaugcccacggcgucggauccgugccuaugcauacugaucuugaauuggacuucagucugacaagcagcuccaaguacaccuauagaaggaaacucacaaacccacuggaggaagcacagucaaucgaucuucacauugagaucgaggaacagacuauuggcguugacgugcaugcccuggggcacugguuugauggacgguugaaucucaagaccaguuuccacuguuacggugcuugcacgaaauaugaguaccccuggcauaccgccaagugucacuaugaacgagacuaccaauaugagacaagcuggggcugcaacccuucggacuguccaggggucggaacuggcugcaccgcaugcggucuguacuuagaucgccugaaacccgugggguccgcguacaagaucauaacaauuagauauucuaggcggguuugugugcaguuuggcgaagagaaucuaugcaagaucauugacaugaacgauuguuucguaagccgccaugucaaagugugcaucauaggaacugugucaaaguuuagucagggcgacacccuccuguucuuugggccgcuugagggagguggcuugaucuucaaacacugguguacguccacaugccaguuuggggauccuggagacauuaugucuccaagagauaagggcuuccugugucccgaguucccugguagcuuuaggaaaaagugcaauuucgcuaccacucccaucugugaauacgacgggaacauggucuccggcuauaaaaagguuauggccacaauugauucauuucaaucuuucaauaccaguacuaugcauuuuaccgacgaacguaucgaguggaaggauccagacggaaugcuccgggaucacauaaacauucuggugacaaaagacaucgacuucgauaacuuaggcgaaaauccuugcaagaucgggcugcagacgucuuccauugagggagcauggggcagcgguguaggguuuacccuuacuuguuuggugucgcucacagagugccccaccuuccugacaucaaucaaagccugcgacaaggcuauuuguuacggagccgaaucugucacucuaacccgaggccagaacacggugaaaguuagugguaagggcgggcacuccggaagcacauuuaagugcugucauggcgaggauugcucucagauagggcugcacgcagcugccccacaucucgacaaagugaauggaaucagcgaaauggagaacuccaaggucuaugaugacggcgcgccgcaaugugguauuaaaugcugguucgugaagucaggggaauggaucaguggaauuuuuagcggcaauuggaucguucugauagugcuuugugucuucuugcuguucucuuuaguacuccuguccauccuuugcccugugagaaaacacaagaagucauga

SEQ ID NO: 10051 - RNA, 3408 nt, Artificial Sequence
  derived and/or modified CDS sequence (opt3) from HTNV(CBAa11-106)__KC576787.1__GP
augggcauguggaaguggcuggugaucgccagccucgucuggcccgcucuuacccugagaaacguuuacgacaugaaaauugagugcccucacacaguguccuucggggaaaauucuguaauaggauauguggaguugccaccgaugcccuuagcagauacugcccagauggucccugaaucaaguuguagcauggacaaccaucaauccaugaauacgaucaccaaguacacacaggugauuuggagggguaaagcggauccaggccagucuucgcagaacucauuugagacuguuagcaccgaaaucgaccugaaggggacaugcgugcuaaaacacaagauggucgaggagaguuaucggucccgcaagucuauuaccuguuacgaucucagcugcaauuccacuuauuguaaacccacacuguacaugaucgugccuauacaugcuugcaacaugaugaagucaugucuuaucgcccugggaccauaucgaguacaaguuguguacgaacguaccuacugcaugacgggcgucuugauugaggguaaauguuucgugcccgaccagaguguggucagcaucauuaagcacgggaucuuugauauagcaucuguucauauugugugcuucuuuguagccgugaaaggaaauacuuauaaacucuucgaacaggucaagaaguccuuugagucaaccuguaacgacacagagaauaaggugcagggcuacuauaucugcauuguuggcgggaacuucgcuccuaucuacgugccaacucuggaugacuuuagaagcauggaagcauucaccggaaucuuuaggaguccgcacggugaggaucacgaccuggccggcgaagagauugcuucuuauuccauagucgggcccgccaaugcgaaagugccucauagcgcaucgucugauacacucuccuuaaucgccuacucagggauuccaaguuauagcucccugucuauccuuaccagcucaacggaagcuaagcacguauucagucccggcuuguuuccuaaacugaaccauacuaauugcgacaaguccgccauaccacuaacauggaccgguaugauugaccuccccggguacuacgaggcaauccacccguguacuguuuucugcgugcugagcggaccuggcgcuucuugugaggccuucucagaaggcgggaucuuuaacauuacaagucccaugugccuugucagcaaacaaaaucgguuccgccugaccgagcaacaggugaacuuugucugucagagaguggauauggacaucguuguguauugcaacggacagaggaagguaauuuugacgaagacccucgucauaggucaguguaucuacacaauuacuucccuguucucuuuacugccaggcguggcgcacucgaucgccguugaacucugcgugccuggguuucauggaugggcaaccgcugcccuucuggucacauucuguuuuggcuggguguugauccccgcuauuacuuucauaauccuaaccguacugaaauuuguggccaauauuuuccacacaagcaaccaggagaaucggcucaaguccguucugcgcaaaaucaaggaagaguuugagaaaaccaaggguucaauggucugcgauguguguaaguaugaaugcgagacuuacaaagaacuuaaggcacauggggugaguugcccacaaucucagugucccuauugcuucacgcacugugagccuacagaagccgcuuuucaggcgcauuacaaagucugccagguuacccaccgauucagagacgaucugaagaaaacugugaccccacaaaacuucacaccgggcuguuauaggaccuugaaucucuuucgguacaagagccguugcuacauuuucacuauguggguguuucuguuaauccuggaguccguacuaugggcagccucagcuagcgagacaccccucacgccugucuggaacgacaaugcccacggagugggcucuguuccaaugcauaccgaucuggaacuugacuucuccuugacuuccagcucuaaguauacauaccgcagaaaacugaccaacccccucgaggaagcacaguccauagaucugcacaucgagauugaggaacagacaaucgggguggacguccaugcccuuggacacugguuugaugguaggcugaauuugaagacuucauuccacuguuauggcgcuugcaccaaauacgaguauccuuggcauacggccaagugucacuacgaacgggacuaucaguacgagaccaguugggggugcaacccaagcgacugucccggagugggcacagguugcacugcaugcgggcucuaccuggaucaauuaaaaccgguuggcucggcguauaagauuaucaccauacgauacucccgcagaguguguguacaguuuggagaagagaaucugugcaagauuaucgacaugaacgauuguuucgucucuaggcaugugaaagugugcauuaucggcacagucagcaaguuuucacagggggacacucuacucuucuuuggaccucuggaggguggcgggcuuauauucaaacacugguguaccaguacgugccaguuuggagauccaggcgacaucaugaguccccgggauaaggguuucuuguguccugaguuccccgggucuuuucgcaaaaagugcaauuucgcuacaaccccaauuugugaauaugacggcaacaugguuagcggauacaaaaaggugauggccacuaucgauuccuuucaaucauucaauacaagcaccaugcauuuuacugacgaaagaauugaguggaaggauccugacggcaugcugagggaucacaucaacauacucguaaccaaagacauugacuucgauaaccugggggaaaaucccugcaagaucggauuacagacaaguucuaucgagggcgcaugggguuccggggugggauuuacgcugaccugucuugucagcuugacugagugcccaacauuccucaccucgauuaaagccugcgacaaggcuaucuguuauggcgccgaaucagugacacugacucguggucagaacaccguuaaagugucuggcaagggaggacacaguggcuccacguuuaagugcugucauggggaggauugcagccagauuggacuacacgcagcugccccgcaucuggacaaagucaauggcauaucugaaaucgagaacagcaagguguacgaugacggugcgccucaaugugggauuaaaugcugguucguuaaguccggagaauggaucucaggcauuuuuagugguaauuggaucgugcucauaguccuguguguauuccuuuuguucagccugguguuacucucuauccugugccccguucggaaacacaagaaguccuga

SEQ ID NO: 10052 - RNA, 3408 nt, Artificial Sequence
  derived and/or modified CDS sequence (opt3) from HTNV(CBAa11-26)__KC576786.1__GP
augggcauguggaaguggcuggugaucgccagccucgucuggcccgcucuuacccugagaaacguuuacgacaugaaaauugagugcccucacacaguguccuucggggaaaauucuguaauaggauauguggaguugccaccgaugcccuuagcagauacugcccagauggucccugaaucaaguuguagcauggacaaccaucaauccaugaauacgaucaccaaguacacacaggugauuuggagggguaaagcggauccaggccagucuucgcagaacucauuugagacuguuagcaccgaaaucgaccugaaggggacaugcgugcuaaaacacaagauggucgaggagaguuaucggucccgcaagucuauuaccuguuacgaucucagcugcaauuccacuuauuguaaacccacacuguacaugaucgugccuauacaugcuugcaacaugaugaagucaugucuuaucgcccugggaccauaucgaguacaaguuguguacgaacguaccuacugcaugacgggcgucuugauugaggguaaauguuucgugcccgaccagaguguggucagcaucauuaagcacgggaucuuugauauagcaucuguucauauugugugcuucuuuguagccgugaaaggaaauacuuauaaguuguucgaacaggucaagaaauccuuugagucaaccuguaacgacacagagaauaaggugcagggcuacuauaucugcauuguuggcgggaacagcgcuccuaucuacgugccaacucuggaugacuucagaaguauggaagcauuuaccggaaucuucaggucuccgcacggugaggaucacgaccuggccggcgaagagauugcuuccuauagcauagucgggcccgccaaugcgaaagugccucauucggcaucuuccgauacacucucauuaaucgccuacagugggauuccaagcuauuccucucugagcauccuuaccucaaguacggaagcuaagcacguauuuucccccggcuuguucccuaaacugaaccauacuaauugcgacaagagcgccauaccacuaacauggaccgguaugauugaccuccccggguacuacgaggcaauccacccguguacuguuuucugcgugcugucuggaccuggcgcuucaugugaggccuucagugaaggcgggaucuucaacauuacaagccccaugugccuugucuccaaacaaaaucgguuucgccugaccgagcaacaggugaacuucgucugucagagaguggauauggacaucguuguguauugcaacggacaaaggaagguaauuuugacgaagacccucgucauaggucaguguaucuacacaauuacuucucuguuuucguuacugccaggcguggcgcacagcaucgccguugaacucugcgugccuggguuccauggaugggcaaccgcugcccuucuggucacauuuuguuucggcuggguguugauccccgcuauuacuuuuauaauccuaaccguacugaaauucguggccaauauuuuucacacauccaaccaggagaaucggcucaagucaguucugcgcaaaaucaaggaagaguucgagaaaaccaaggguaguauggucugcgauguguguaaguaugaaugcgagacuuacaaagaacuuaaggcacauggggugucuugcccacaaagccagugucccuauugcuuuacgcacugugagccuacagaagccgcuuuccaggcgcauuacaaagucugccagguuacccaccgauuuagagacgaucugaagaaaacugugaccccacaaaacuucacaccgggcuguuauaggaccuugaaucucuuccgguacaagucccguugcuacauuuuuacuauguggguguuccuguuaauccuggagucaguacuaugggcagccagcgcuucugagacaccccucacgccugucuggaacgacaaugcccacggagugggcuccguuccaaugcauaccgaucuggaacuugacuuuaguuugacuucuagcuccaaguauacauaccgcagaaaacugaccaacccccucgaggaagcacagucaauagaucugcacaucgagauugaggaacagacaaucgggguggacguccaugcccuuggacacugguucgaugguaggcugaauuugaagaccaguuuucacuguuauggcgcuugcacuaaauacgaguauccuuggcauacggccaagugucacuacgaacgggacuaucaguacgagaccagcugggggugcaacccaucggacugucccggagugggcacagguugcacugcaugcgggcucuaccuggaucaauuaaaaccgguuggcuccgcguauaagauuaucaccauacgauacucucgcagaguguguguacaguucggagaagagaaucugugcaagauuaucgacaugaacgauuguuuugucagcaggcaugugaaagugugcauuaucggcacagucucaaaguucagucagggggacacucuacucuuuuucggaccucuggaggguggcgggcuuauauuuaaacacugguguaccuccacgugccaguucggagauccaggcgacaucaugucuccccgggauaaggguuuucucuguccugaauuucccgggagcuuccgcaaaaagugcaauuuugcuacaaccccaauuugugaguaugacggcaacaugguuuccggauacaaaaaggugauggccacuaucgauucauuccagagcuuuaauacaaguaccaugcauuucacugacgaaagaauugaguggaaggauccugacggcaugcugagggaucacaucaacauacucguaaccaaagacauugacuuugauaaccugggggaaaaucccugcaagaucggauuacagacaucuuccaucgagggcgcaugggguagcggggugggauucacgcugaccugucuugucucguugacugagugcccaacauuucucaccucaauuaaagccugcgacaaggcuaucuguuauggcgccgaaucugugacacugacucguggucagaacaccguuaaagugaguggcaagggaggacacuccggcagcacguucaagugcugucauggggaggauugcucucagauuggacuacacgcagcugccccgcaucuggacaaagucaauggcauaagcgaaaucgagaacuccaagguguacgaugacggugcgccucaaugugggauuaaaugcugguuuguuaagucaggagaauggaucaguggcauuuucagcgguaauuggaucgugcucauaguccuguguguauuucuuuuguucucucugguguuacucuccauccugugccccguucggaaacacaagaagucauga

SEQ ID NO: 10053 - RNA, 3408 nt, Artificial Sequence
  derived and/or modified CDS sequence (opt3) from HTNV(Fuyuan-Aa-145)__KJ857336.1__GP
augggcauguggaaguggcuggugaucgccagccucgucuggcccgcucuuucccugagaaacguuuacgacaugaaaauugagugcccucacaccgugucuuucggggaaaauucaguaauaggauauguggaguugccaccgaugcccuuagcagauacagcccagauggucccugaaaguagcuguuccauggacaaccaucaaucuaucaauacuauuacgaaguacacccaggugaucuggagggguaaagcggauccaggccagucgucacagaacagcuuugagacaguuaguacugaaguggaccugaaggggaccugcguccuaaaacacaagaugguggaggaguccuaucggucucgcaagagcauuacauguuacgaucucuccugcaauucaaccuucuguaaacccacucuguauaugaucguaccuauacaugcuugcaacaugaugaagaguugucuuaucgcccugggaccauaccgaguucaaguggucuaugaacguacauacugcaugaccggcguguugauugaggguaaauguuuugugcccgaccagagcgucguuucuaucauuaagcacgggaucuucgauauagcauccgugcauguagugugcuuuuucgucgccgugaaaggaaauacguacaagcucuuugaacagguuaagaaaucauucgagagcacuuguaacgacaccgagaauaaggugcagggcuauuacauuugcaucgucggcgggaacagugcuccuauuuaugugccaacacuggaugacuuuagaucuauggaagcauucacuggaaucuuuaaauccccgcacggugaggaucacgaccuggccggcgaagagaucgcuagcuacucgauuguagggcccgccaaugcgaagguuccucauucugcauccucagauacccucaguuuaauagccuauagcggaaucccauccuacucuagccugucaauucuuacaaguuccaccgacgcuaaacacguguucagccccggcuuguuuccuaagcugaaccauacgaauugcgacaaaucugccaucccacuaacuuggacagguaugauagaucuccccggguauuacgaagcaauucacccguguaccgucuucugcgugcugucaggaccuggcgcuaguugugaggccuucagcgagggcgggaucuuuaacaucacuucccccaugugccuugucucuaagcaaaauagguuccggcugacagaacaacaggugaacuuuguuugucagcgcguggacauggauauuguagucuacugcaacggacagagaaaggugaucuugaccaaaacgcucguuauuggucaguguauauauaccaucacaucgcuguucagcuuacugccaggcguggcgcacuccauugccgucgagcucugcgugccuggguuucauggaugggcaacugcugcccuucugguaaccuucuguuuuggcuggguguugauccccgcuguuacauucaucauucuaacuguccugaaguuuauagccaauaucuuccacaccucaaaccaggaaaauaggcucaaaagugugcugcggaagauuaaagaggaauuugagaagacaaaggguucuauggugugcgacgucuguaaauacgagugcgaaaccuauaaggagcuuaaagcacaugggguuagcugcccacaaucccagugucccuacugcuucacucacugugaaccuacggaggccgcuuuucaggcgcauuauaaggugugccaggugacacaccgcuuccgagaugaccugaaaaagaccguaacuccacaaaacuucaccccgggcuguuacagaacauugaaucucuuuagguauaagucacggugcuacaucuucaccaugugggucuuucuguuaauucuggaaagcgugcuaugggcagccucugcuuccgagacuccccucacaccuguuuggaacgauaaugcccacggagugggcagugucccaaugcauacggaccuggagcuugauuucagcuugaccucuuccucaaaauacacuuaucgucgcaagcugacaaacccccucgaagaggcacagaguaucgaccugcacauagaaaucgaggagcagaccauugggguggauguucaugcccuuggacacugguuugacgguagacugaauuugaaaacuagcuuccacuguuacggcgcuugcacaaaguaugaauacccuuggcauaccgccaaaugucacuaugagagggacuaccaguaugaaacgucgugggggugcaacccauccgauugucccggagugggcaccgguugcacagcaugcgggcucuaccuggaccaauuaaagccgguaggcucugcguacaagaucauuacuauccgguauagccgacgcgucugugugcaguuuggagaggaaaaucugugcaaaauaauugauaugaacgacuguuucgugucaagacaugucaagguuugcaucauuggcaccgugaguaaauuuucccagggggauacacuacucuucuuuggaccucuggaggguggcgggcuuaucuucaagcacugguguacuucuaccugccaguuuggagacccaggcgauauaaugagccccagggacaaagguuucuuguguccugaguuccccggguccuuucggaagaaaugcaauuucgcuacgacaccaaucugugaauacgauggcaacaugguaucaggauauaagaaggugauggccaccauugacagcuuucaaaguuucaauacuucuacaaugcauuuuaccgaugagcgcaucgaauggaaagacccugauggcaugcugagagaccacauuaacauccucgucacuaaggacauagauuucgacaaccugggggagaaucccugcaaaauuggauuacagaccuccagcaucgaaggcgcaugggguucgggggugggauuuacacugacgugucuuguuucauugaccgagugcccaacuuuccucacaucuaucaaggccugcgauaaagcuauuuguuacggcgccgagagugugacccugacaaggggucagaacacugucaagguguccggcaaagggggacacagcggcucuaccuuuaagugcugucauggggaagacugcagcaagaucggacuacacgcagcugccccgcaucuggauaaaguuaauggcauuuccgagauagaaaacucaaagguguaugacgauggugcgccucagugugggaucaaaugcugguucgucaagaguggagaguggauuagcggcaucuuuucugguaauuggauuguacucaucgugcuguguguuuuccuuuuguucucccugguguuacucucaauacugugccccguccguaagcacaaaaagaguuga

SEQ ID NO: 10054 - RNA, 3408 nt, Artificial Sequence
  derived and/or modified CDS sequence (opt3) from HTNV(Fuyuan-Aa-26)__KJ857334.1__GP
augggcauguggaaguggcuggugaucgccagccucgucuggcccgcucuuucccugagaaacguuuacgacaugaaaauugagugcccucacaccgugucuuucggggaaaauucaguaauaggauauguggaguugccaccgaugcccuuagcagauacagcccagauggucccugaaaguagcuguuccauggacaaccaucaaucuaucaauacuauuacgaaguacacccaggugaucuggagggguaaagcggauccaggccagucgucacagaacagcuuugagacaguuaguacugaaguggaccugaaggggaccugcguccuaaaacacaagaugguggaggaguccuaucggucucgcaagagcauuacauguuacgaucucuccugcaauucaaccuauuguaaacccacucuguacaugaucguaccuauacaugcuugcaacaugaugaagaguugucuuaucgcccugggaccauaucgaguucaaguggucuacgaacguacauacugcaugaccggcguguugauugaggguaaauguuucgugcccgaccagagcgucguuucuaucauuaagcacgggaucuuugauauagcauccgugcauauuguaugcuucuuuguggccgucaaaggaaauacguauaaacucuucgaacaggugaagaagucauuugagagcacuuguaacgacaccgagaauaagguucagggcuacuauaucugcauugugggcgggaacagugcuccuaucuacgucccaacacuggaugacuucagaucuauggaagcauuuacuggaaucuucaaauccccgcacggugaggaucacgaccuggccggcgaagagauugcuagcuauucgauaguggggcccgccaaugcgaagguaccucauucugcauccucagauacccucaguuuaaucgccuacagcgggauuccauccuauucuagccugucaauccuuacaaguuccaccgacgcuaaacacguuuuuagccccggcuuguucccuaagcugaaccauacgaauugcgacaaaucugccauaccacuaacuuggacagguaugauugaucuccccggguacuacgaagcaauccacccguguaccguguuuugcguccugucaggaccuggcgcuaguugugaggccuucagcgagggcgggaucuucaacauuacuucccccaugugccuugugucuaagcaaaauagguuucggcugacagaacagcaggucaacuucgugugucagcgcguugacauggauaucgugguauauugcaacggacaaagaaaggucauuuugaccaaaacgcucgugauaggucaguguaucuacaccauuacaucgcuguuuagcuuacugccaggcguugcgcacuccaucgccguggagcucugcgucccuggguuccauggaugggcaacugcugcccuucuggugaccuuuuguuucggcuggguauugauccccgcugugacauuuauuauacuaacuguucugaaguucaucgccaauauuuuucacaccucaaaccaggaaaauaggcucaaaaguguccugcggaagaucaaagaggaauuugagaagacaaaggguucuauggugugcgacguguguaaauaugagugcgaaaccuacaaggagcuuaaagcacauggggucagcugcccacaaucccagugucccuauugcuuuacucacugugaaccuacggaggccgcuuuccaggcgcauuacaagguuugccaggugacacaccgcuuucgagaugaccugaaaaagaccgugacuccacaaaacuucaccccgggcuguuauagaacauugaaucucuucagguacaagucacggugcuacauuuuuaccauguggguauuccuguuaauccuggaaagcguccuaugggcagccucugcuuccgagacuccccucacaccuguguggaacgauaaugcccacggaguuggcagugugccaaugcauacggaccuggagcuugauuuuagcuugaccucuuccucaaaauauacuuaccgucgcaagcugacaaacccccucgaagaggcacagaguauagaccugcacaucgaaauugaggagcagaccaucggggucgaugugcaugcccuuggacacugguucgacgguagacugaauuugaaaacuagcuuucacuguuauggcgcuugcacaaaguacgaauauccuuggcauaccgccaaaugucacuacgagagggacuaucaguacgaaacgucgugggggugcaacccauccgauugucccggaguuggcaccgguugcacagcaugcgggcucuaccuggaccaauuaaagccggugggcucugcguauaagauuaucacuauacgguacagccgacgcguauguguccaguucggagaggaaaaucugugcaaaauuaucgauaugaacgacuguuuugugucaagacaugugaaggucugcauuaucggcaccguuaguaaauucucccagggggauacacuacucuuuuucggaccucuggaggguggcgggcuuauauuuaagcacugguguacuucuaccugccaguucggagacccaggcgauaucaugagccccagggacaaagguuucuuguguccugaguuccccggguccuuccggaagaaaugcaauuuugcuacgacaccaauuugugaauaugauggcaacauggugucaggauacaagaagguaauggccaccaucgacagcuuccaaaguuuuaauacuucuacaaugcauuucaccgaugagcgcauugaauggaaagacccugauggcaugcugagagaccacaucaacauacucgugacuaaggacauugauuuugacaaccugggggagaaucccugcaaaaucggauuacagaccuccagcaucgaaggcgcaugggguucgggggucggauucacacugacgugucuugugucauugaccgagugcccaacuuuucucacaucuauuaaggccugcgauaaagcuaucuguuauggcgccgagaguguuacccugacaaggggucagaacacugugaaggucuccggcaagggaggacacagcggcucuaccuucaaaugcugucauggggaagacugcagcaagauuggacuacacgcagcugccccgcaucuggauaaagugaauggcauauccgagaucgaaaacucaaagguuuacgacgauggugcgccucagugugggauuaaaugcugguuugugaagaguggagaguggaucagcggcauuuucucugguaauuggaucguccucauaguacuguguguguuucuuuuguucucccugguuuuacucucaauccugugccccgugcguaagcacaaaaagaguuga

SEQ ID NO: 10055 - RNA, 3408 nt, Artificial Sequence
  derived and/or modified CDS sequence (opt3) from HTNV(JS1)__KP970560.1__GP
augggcaucuggaaguggcuggugauggccagccucgucuggcccguucuuacccugagaaacguguacgacaugaagauugagugcccucacacaguauccuucgggggaaauucugugauagguuaugucgaauugccaccggugcccuuagcugauacugcacagaugguuccugagucaaguuguagcauggacaaccaucaaucccugaauacgaucgccaaguacacccaggugucuuggaggggcaaagcggaucagucgcagucaagccaaaacaguuuugaaacagucuccacugagguggaccuaaaggggaccugcguacucaaacacaagaugguugaagagucuuaucggagccgcaaguccgugacauguuacgaucugucaugcaauaguaccuauuguaaaccaacucuuuacaugauuguccccauccaugcuugcaacaugaugaagaguugucugauugccuugggaccuuaucgaguccaggugguguacgagcguacauacugcaugaccggcguucucaucgaagguaaauguuucgugccagaccagucuguaguguccauaaucaagcacgggauuuuugauaucgcaucaguccauauugugugcuucuuuguugccgugaaaggaaauacguauaagaucuucgagcaggucaagaaaaguuuugaaaguacuuguaacgacaccgagaauaaggugcaaggcuacuauauaugcauuguaggcgggaacucugcucccaucuacguuccuacacuggaugacuucagauccauggaggcauuuacuggaauuuucaggagcccacacggugaagaucacgaccuggccggcgaggaaaucgcuucguauucuaucguggggccggccaaugcgaaagucccccauuccgcaucaagugauacccucagcuuaauugccuacuccggaauaccuucuuauagcucacugaguauccuuacauccagcaccgaggcuaagcacguguuuucuccaggcuuguuccccaaacugaaccauacgaauugcgacaagucagccauuccucuaaucuggacugguaugauagaccucccaggguacuacgaagcaguccaccccuguacaguguuuugcguucugaguggaccgggcgcuagcugugaggccuucuccgagggcgggauuuucaacaucaccucuccuaugugccuugugucgaaacagaaucgguuucgccugacugaacagcagguaaacuucgucugucaaagaguggauauggacaucguuguguauugcaacggacagaggaaggucauuuugacaaagacccucgugaucggucaguguauuuacacgauaaccagccuguuuuccuuacugcccggcguagcgcacucaaucgccguggagcucugcguuccaggguuccauggaugggcaacagcugcccuucuggucacuuuuuguuucggcuggguguugauuccugcuaucaccuuuaucauucuaacagugcugaaauucauagccaauaucuuucacacuagcaaccaagaaaaucggcucaagucuguccugcgcaaaauuaaggaggaauuugagaaaaccaaggguagcaugguuugcgauguguguaaguaugagugcgaaacauacaaagagcuuaaggcacaugggguguccugcccccagucacaguguccauauugcuucacccacugugaacccacugaggccgcuuuccaggcgcauuacaaaguaugccaagucacgcaccgauuuagagacgaucugaagaaaacagugaccccucagaacuucacuccaggcuguuauaggaccuugaaucucuuccgguacaagagccguugcuacaucuuuacaauguggauuuuccuguuaguucuggaaucuauccuaugggcagccuccgcuagugagaccccgcucacucccguguggaacgacaaugcccacggagucggcagcgugccuaugcauacagaucuggagcuugacuuuucuuugacguccucaaguaaguauaccuaccgcagaaaacugacuaacccacucgaagaggcacagagcauagaucugcacaucgaaauugaggagcagacaaucgggguugacgugcaugcccuuggacacugguucgaugguaggcugaauuugaagaccucguuucacuguuauggcgcuugcacaaaauacgaauaucccuggcauacugccaagugucacuacgagcgggacuaucaauacgaaaccuccugggggugcaacccuucugacuguccaggaguaggcacggguugcaccgcaugcgggcucuaccuggaucaguuaaaacccgucggcagcgcguauaagauuaucacaauacgauacucacgcagagugugugugcaguucggagagggcaaucugugcaagauuaucgacaugaacgauuguuuugucaguaggcauguuaaagugugcauuaucgggacuguauccaaguucucucagggagacacccuacucuuuuucgguccgcuggaaggcgggggacuuauauuuaaacacugguguacaagcacuugccaauucggcgauccuggugacaucauguccccacgggauaagggguuuuugugucccgaguucccuggcucauuccgcaaaaagugcaauuuugcuaccacgcccauuugugaguaugacggaaacauggugagcggcuacaaaaaggucauggccacaaucgauaguuuccagucuuuuaauaccuccacuaugcauuucacagacgaaagaauugaguggaaggauccagacgggaugcugagggaucacaucaacauacucgugaccaaagacauugacuuugauaaccugggagaaaauccuugcaagaucggcuuacagacuagcucgaucgagggugcaugggggucaggaguuggcuucacccugacaugucuugugucuuugacggaaugccccaccuuucucacuagcauuaaagccugcgacaaggcuaucuguuauggugccgaguccgucacacugacccguggccagaacacagugaaaguuagcgggaagggaggccacucugggagcacuuucaagugcugucauggagaggauugcucccaaauuggccuacacgcagcugccccacaucuggacaaagugaaugguauaucagaaaucgagaacaguaaggucuacgaugacggggcgccgcaguguggaauuaaaugcugguuuguaaagagcggcgaauggaucucugguauuuucuccggcaauuggaucgugcucauaguucuguguguguuucuuuuguucucacuggucuuacucaguauccugugcccugugcggaaacacaaaaagagcuga

SEQ ID NO: 10056 - RNA, 3408 nt, Artificial Sequence
  derived and/or modified CDS sequence (opt3) from HTNV(LongquanAa-08-150)__JQ912803.1__GP
augggcaucuggaaguggcuggugauggccagccucgucuggcccgcuuucacccuuagaaacguuuacgacaugaaaauugagugcccucacacaguguccuuuggggaaaauucuguaauaggauauguggagcugccaccgaugcccuuggcagauacugcccagauggucccugaaucaaguuguaacauggacaaucaucaaagcaugaacacgaucaccaaguacacacagguguccuggagggguaaagcggaucaggcucaggccucucaaaauucguucgaggcaguuucagccgaaguggacuuaaagggcauuugcguccugaaacacaagaugcuagaggagagcuaucggagucgcaaguccaucacuuguuacgaucucucuugcaacagcaccuauuguaaaccaacacuguacaugauugugcccauccaugcuugcaauaugaugaaguccugucuuauagcacuggggccuuaucgaguacagguuguguacgaacguaccuacugcaugacuggagucuugcucgagggcaaauguuuugugccagaccagucaguggucaguaucauuaagcacgguaucuucgauauugccagcguucauaucgugugcuuuuucguagcugugaaagggaacacauauaagcugcuggaacaggucaagaaaucuuuucaauccaccuguaaugacacggagaacaaggugcagggauacuauauaugcauuguuggcggcaauucagcccccaucuacgugccuacucucgaugacuucagaagcauggaggcguuuagugggauuuucaggucuccacacggagaagaucacgacuuagccggugaggaaaucgcauccuauagcaucgucggcccggcuaacgccaaagugccccauucggcaucuuccgauacccugucacuuauugcuuacagugggauaccuagcuauuccucuuugagcauccuggccucaaguacagaggcgaagcacguauuuuccccaggauucuuuccccagcuaaaucauacuaaaugcgacaagaccgccauuccucucaucuggacaggcaugauagaccugccagguuacuacgaagcaauucaccccuguaccguuuucugcgugcuuagcgggccgggagcuucuugugaggccuucucagagggcggcaucuuuaacaucacgaguccuaugugccuggucagcaaacagaaucgguuccgcuugacugaacaacaggugaacuuugucugucagagaguggauguugacauuaucguguauugcaacgggcaaaggaagguaauucucacaaagacccuggucauaggacaguguaucuacacuauuacauccuuauucucucugcuccccgguguggcucacucgaucgccguugagcuuugcgugccaggcuuucaugggugggcaaccgccgcucuguuggucacguucuguuuuggaugggugcuaaucccugcgcugacccucauuauacugacaauccuuaaauucauugcaaauaucuuucacacuugcaaccaggaaaaucggcugaaaagcguauugcgcaagauuaaggaggaauuugagaaaaccaagggcuccauggugugugauguuugcaaguaugagugcgaaacauacaaagagcucaaggcccauggugucucauguccccagagucaaugcccauauuguuucacucacugcgaacccaccgaggcugccuuccaggcacauuaccgagugugucaggugacacacagauuuagggacgaucugaaaaagaccgucacuccucagaacuucacgccagggugcuaucggacauuaaaucuguuccguuacaaaucucgcuguuacaucuuuaccauguggguuugccuacucgugcuggaaagcauacuuugggccgcuuccgccucagaggugccguugaaccccguauggaaugacaacgcacacggcgucggaagcgugccuaugcauacugaucuggagcucgacuucucucugaccuccaguagcaaguauacauacagaaggcggcuuaccaauccacuggaagagacucaaucuaucaacuugcacauugaaaucgaggagcagacaauuggcguugaugugcaugcgcucgggcacugguuugacggacgacugaauuuaaagacguccuuccacuguuauggugcuugcaccaaauacgaauaucccuggcauacugccaagugucacuacgagcgcgauuaucaguacgaaacaucauggggcugcaacccugcagacugcccaggggucggaaccggcuguacagccugcggucuguaccuagaccagcucaaacccguggggagugcuuauaagaucauaacuauuagauacagcaggaaaguuugugugcaauuuggcgaggaaaaucugugcaagguaaucgauaugaacgacuguuucgucacccggcaugugaaggugugcauuaucggaacggucucgaaauuuucccagggcgauacccuuuuguucuuugggccgcuggagggagguggccucauauucaagcacugguguacaucuacuugccaguuuggggacccuggagauaucaugagcccacgcgacaaaggcuuccugugucccgaguuuccugguucauucagaaagaaaugcaauuucgccaccacacccuuaugugaauaugaugggaacaugguuaguggcuacaagaaagugauggcaacuauugacuccuuucagucuuucaacaccagcacgaugcauuuuacagaugagaggaucgaauggaaggacccagauggaaugcugcgugaccacauuaauauccuuguaaccaaggauauagacuucgacaacuugggcgagaauccuugcaaaauugggcuccaaacuuccucaaucgaaggagcuuggggcagcggugugggguuuacacugaccugccuaaucagucugacugagugucccaccuuccucacaucuauuaaggccugcgauaaagcgaucuguuauggagccgaguccgucacgcugacccggggccagaacacugugaagguuagcgguaaaggcgggcacucgggaucaacauuuaagugcugucauggcgaagagugcucucagauugggcuucacgcugcagccccacauuuggacaaggugaauggaauaagugaaaucgagaacaauaaagucuacgaugacggcgcuccgcaauguggugugaagugcugguucguuaaauccggggaauggauuagcggaaucuuuucuggcaacuggauugugcugaucgucuuauguguauuccuccuguuuagccuugugcuguuguccguucucugcccugugcgaaagcacaaaaagucauga

SEQ ID NO: 10057 - RNA, 3408 nt, Artificial Sequence
  derived and/or modified CDS sequence (opt3) from HTNV(LongquanAa-08-157)__JQ912804.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugucaccaaugccguuggcagauacugcccagaugguccccgagaguagcuguaacauggacaaucaucaauccaugaacacgaucaccaaguacacacaggugucuuggaggggaaaagcggaucaggcucaggccucgcaaaauucauucgaagcaguuagcgccgagguggacuuaaaggguacuugcguccugaaacacaagaugcuagaggaaaguuaucggucccgcaagucuauuaccuguuacgaucucagcugcaacuccacauauuguaaaccuacccuguacaugaucgugccaauucaugcuugcaauaugaugaagucaugucuuaucgcacugggccccuaucgaguacagguuguguacgagcguacuuacugcaugacaggggucuugauagaaggaaaauguuuugugccugaccagaguguggucagcaucauuaagcacggcaucuucgauauugccucuguucauaucgugugcuuuuucguagcugugaaagguaacaccuauaagcucuuugagcaggucaagaaauccuuccaaucaacguguaaugggacugagaacaaggugcagggauacuauauaugcauuguuggcggcaauagcgccccaaucuacgugcccacccuggacgauuuuagaaguauggaagcguucucugggauuuuuagguccccucacggagaggaccacgaucuggccggugaagagaucgccagcuauucgaucgucggcccagcuaacgccaaagugccgcauucugcauccucagacacacucaguuuaauugcuuacagcgggauacccuccuauucuagccugucaauccuugccaguuccacugaagcgaagcacguauucagcccuggauuuuucccacaguugaaucauaccaaaugcgauaagacagccauuccccugaccuggacgggcaugaucgaccuaccugguuacuacgaggcaauacacccauguacuguuuucugcgugcucucugggcccggagcuucaugugaggccuuuagugaaggcggcauuuucaacaucacaagcccgaugugccuggucuccaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucucucuuuucgcuguuaccuggugucgcucacagcauugccguggaacugugcguucccggcuuccaugggugggcaaccgccgcucuccuugugacauuuuguuucggauggguccugaucccagcguugacucuaaucauucugaccauacucaaauuuaucgcaaaucuguuccacacauccaaccaggagaaucggcuuaagucagugcugcgcaaaauuaaggaagaguuugagaaaacuaagggcaguaugguaugcgacguguguaaguaugaaugcgagaccuacaaagaauugaaggcccaugguguuucuugcccucagagccaaugucccuauugcuucacacacugugagccaaccgaagcugccuuucaggcacauuaccgagucugccaggugacucacagauucagggaugaccucaaaaagacggugacaccccagaacuucaccccuggguguuaucggacucugaauuuauuucguuacaaaucccgcugcuacaucuucaccaugugggucugucugcuaguucucgagucaauucugugggccgcuagcgccucugaggugccacuuaacccgguguggaaugauaacgcacacggcguaggauccguccccaugcauacagacuuggaacuggauuuuagucucaccaguucuuccaaguauacuuacagaaggcggcugacaaauccucuugaggaaacgcaaucaaucaaccugcacauagagaucgaggaacagaccauuggcguggacguucaugcguuggggcacugguucgauggacgacucaaucugaagacuagcuuucacugcuauggugcuuguacaaaauacgaguauccauggcauaccgccaagugccacuacgaacgcgacuaucaguacgagacaagcuggggcuguaaccccgcagauugcccuggggugggaacuggcugcaccgccugugguuuauaccuggaccagcuaaaaccagucgggucggcuuauaagaucauuacgaucagauacuccaggaaagugugcguucaauucggcgaagagaaucucuguaaggugauagacaugaacgauugcuuuguaacccggcaugucaagguguguauuaucggaacagugucuaaauucagccagggcgacacucugcucuuuuucgggcccuuggagggagguggccugauuuuuaagcacuggugcaccucaacaugucaguucggggauccgggagacaucaugaguccucgcgauaaaggcuuucucugcccagaguuccccgguuccuucagaaagaaauguaauuuugccacuaccccucugugcgaguaugacgggaacauggucucuggcuacaagaaaguuauggcaacgauagauagcuuccaguccuuuaacacaucaaccaugcauuucacugacgaaaggaucgaguggaaggaucccgacggaauguuacgugaucacauuaauauccuggugacaaaggacauugauuuugacaaccuuggcgaaaauccauguaaaaucggguugcaaaccagcaguauagagggagcuuggggcucugguguaggguucacucuuaccugccugauuucccuaacagagugcccuacguuucugaccagcaucaaggccugugacaaagcgaucugcuauggagccgaaucggugacucucacacggggccagaacaccgucaaggugucagguaaaggcgggcacucuggaaguacauucaaguguugccauggcgaggaauguucccagauugggcugcacgcugcagcaccccaucuugauaagguuaauggaaucagcgagauugaaaacaauaaaguguacgacgauggcgcuccacaaugcggugucaaguguugguuugugaaaucuggggaguggauaagcggaaucuucuccggcaacuggauuguuuugaucgugcugugcgucuuuuuacucuucucacugguacuucugaguguguuguguccgguucgaaagcacaaaaagagcuga

SEQ ID NO: 10058 - RNA, 3408 nt, Artificial Sequence
  derived and/or modified CDS sequence (opt3) from HTNV(LongquanAa-08-196)__JQ912805.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagcccccaucuacgugccuacccuggacgauuuuagaagcauggaagcguucagugggauuuuuaggucuccacacggagaggaccacgaucuggccggugaagagaucgcauccuauagcaucgucggcccggcuaacgccaaagugccccauucggcaucuuccgacacacucucauuaauugcuuacagugggauaccuagcuauuccucucugagcauccuugccucaaguacugaagcgaagcacguauucuccccaggauuuuucccccaguugaaucauaccaaaugcgauaagacagccauuccucugaccuggacgggcaugaucgaccuaccagguuacuacgaggcaauacaccccuguacuguuuucugcgugcucagcgggccgggagcuucuugugaggccuuuucagaaggcggcauuuucaacaucacaaguccuaugugccuggucagcaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucccucuuuucucuguuacccggugucgcucacucgauugccguggaacugugcguuccaggcuuccaugggugggcaaccgccgcucuccuugugacauuuuguuucggauggguccugaucccugcguugacucuaaucauucugaccauacucaaauuuaucgcaaauauuuuccacacaagcaaccaggagaaucggcugaaguccgugcuucgcaaaaucaaggaagaguuugagaaaacuaagggcucaaugguaugcgacguguguaaguaugaaugcgagaccuacaaagaacugaaggcccaugguguuaguugcccccagucucaauguccauauugcuucacacacugugagcccaccgaagcugccuuucaggcacauuaccgagucugccaggugacucacagauucagggaugacuugaaaaagacggugacaccucagaacuucaccccaggguguuaucggacucucaaucuguuucguuacaaaagccgcugcuacauuuucaccaugugggucuguuuacugguucuagaguccauccucugggccgcuucagccagcgaggugccgcugaaccccguguggaaugauaacgcacacggcguaggaucugucccuaugcauacagaccuugaauuggauuuuucccugaccaguagcucuaaguauacuuacagaaggcggcucacaaauccacuggaggaaacgcaauccauaaaccuucacaucgagauugaggaacagaccaucggcguggacguucaugcgcuggggcacugguucgauggacgauugaaucucaagacuucauuucacugcuauggugcuuguacaaaauacgaguaucccuggcauaccgccaagugccacuacgaacgcgacuaucaguacgagacaaguuggggcuguaacccugcagauugcccaggggugggaacuggcugcaccgccuguggucuguacuuagaccagcugaaacccgucgggagcgcuuauaagauuaucacgauaagauacucgaggaaagugugcguucaauucggcgaagagaaucuauguaaggugauugacaugaacgauugcuuuguaacccggcaugucaagguguguaucauuggaacaguguccaaauucucucagggcgacacucuccuguuuuucgggccgcuugagggagguggcuugaucuuuaagcacuggugcaccagcacaugucaguucggggauccuggagacauaaugucaccacgcgauaaaggcuuucugugccccgaguucccugguaguuucagaaagaaauguaauuuugccacuacgccccucugcgaguaugacgggaacauggucuccggcuacaagaaaguuauggcaaccaucgauucuuuccagagcuuuaacacauccaccaugcauuucacugacgaaaggauugaguggaaggauccagacggaaugcugcgugaucacaucaauauuuuagugacaaaggacaucgauuuugacaaccugggcgaaaauccuuguaaaauagggcuucaaaccucaagcauugagggagcuuggggcagugguguaggguucacuuugaccugccucaucucucugacagagugccccacguuucuaaccuccaucaaggccugugacaaagcgauuugcuauggagccgaaagcgugacucugacacggggccagaacaccgucaaggugucggguaaaggcgggcacucaggaucuacauucaaguguugccauggcgaggaauguagucagaucgggcuccacgcugcagccccacaucuggauaagguuaauggaauuuccgagauagaaaacaauaaaguguacgacgauggcgcuccgcaaugcggugucaaguguugguuugugaaaagcggggaguggaucucuggaauuuucagcggcaacuggaucguucuuauuguguugugcgucuuucuguuauucucccucguacugcuuucagugcuguguccuguucgaaagcacaaaaagaguuga

SEQ ID NO: 10059 - RNA, 3408 nt, Artificial Sequence
  derived and/or modified CDS sequence (opt3) from HTNV(LongquanAa-08-235)__JQ912810.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagcccccaucuacgugccuacccuggacgauuuuagaagcauggaagcguucagugggauuuuuaggucuccacacggagaggaccacgaucuggccggugaagagaucgcauccuauagcaucgucggcccggcuaacgccaaagugccccauucggcaucuuccgacacacucucauuaauugcuuacagugggauaccuagcuauuccucucugagcauccuugccucaaguacugaagcgaagcacguauucuccccaggauuuuucccccaguugaaucauaccaaaugcgauaagacagccauuccucugaccuggacgggcaugaucgaccuaccagguuacuacgaggcaauacaccccuguacuguuuucugcgugcucagcgggccgggagcuucuugugaggccuuuucagaaggcggcauuuucaacaucacaaguccuaugugccuggucagcaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucccucuuuucucuguuacccggugucgcucacucgauugccguggaacugugcguuccaggcuuccaugggugggcaaccgccgcucuccuugugacauuuuguuucggauggguccugaucccugcguugacucuaaucauucugaccauacucaaauuuaucgcaaauauuuuccacacaagcaaccaggagaaucggcugaaguccgugcuucgcaaaaucaaggaagaguuugagaaaacuaagggcucaaugguaugcgacguguguaaguaugaaugcgagaccuacaaagaacugaaggcccaugguguuaguugcccccagucucaauguccauauugcuucacacacugugagcccaccgaagcugccuuucaggcacauuaccgagucugccaggugacucacagauucagggaugacuugaaaaagacggugacaccucagaacuucaccccaggguguuaucggacucucaaucuguuucguuacaaaagccgcugcuacauuuucaccaugugggucuguuuacugguuuuugaguccauccuaugggccgcuucagccagcgaggugccgcucaaccccguguggaaugauaacgcacacggcguaggaucugucccuaugcauacagaccuggaacuugauuucuccuugaccaguagcucuaaguauacuuacagaaggcggcugacaaauccacucgaggaaacgcaauccauaaaccugcacaucgagauugaggaacagaccaucggcguggacguucaugcgcuugggcacugguuugauggacgacugaauuugaagacuucauuccacugcuauggugcuuguacaaaauacgaguaucccuggcauaccgccaagugccacuacgaacgcgacuaucaguacgagacaaguuggggcuguaacccugcagauugcccaggggugggaacuggcugcaccgccuguggucucuaccuggaccaguuaaaacccgucgggagcgcuuauaagauuaucacgauaagauacucgaggaaagugugcguucaauuuggcgaagagaaucuguguaaggugauugacaugaacgauugcuucguaacccggcaugucaagguguguaucauuggaacaguguccaaauuuucucagggcgacacucuacucuucuuugggccgcuggagggagguggccuuaucuucaagcacuggugcaccagcacaugucaguuuggggauccuggagacauaaugucaccacgcgauaaaggcuucuugugccccgaguucccugguaguuuuagaaagaaauguaauuucgccacuacgccccugugcgaguaugacgggaacauggucuccggcuacaagaaaguuauggcaaccaucgauucuuuucagagcuucaacacauccaccaugcauuuuacugacgaaaggauugaguggaaggauccagacggaaugcuccgugaucacaucaauauucuggugacaaaggacaucgauuucgacaacuuaggcgaaaauccuuguaaaauagggcugcaaaccucaagcauugagggagcuuggggcagugguguaggguuuacucuuaccugcuugaucucucucacagagugccccacguuccugaccuccaucaaggccugugacaaagcgauuugcuauggagccgaaagcgugacucuaacacggggccagaacaccgucaaggugucggguaaaggcgggcacucaggaucuacauuuaaguguugccauggcgaggaauguagucagaucgggcugcacgcugcagccccacaucucgauaagguuaauggaauuuccgagauagaaaacaauaaaguguacgacgauggcgcuccgcaaugcggugucaaguguugguucgugaaaagcggggaguggaucucuggaauuuuuagcguuaacuggaucgugcugauuguccuuugcguauucuugcuguucuccuuagugcuccugucaguucuuuguccugugcgaaagcacaaaaagaguuga

SEQ ID NO: 10060 - RNA, 3408 nt, Artificial Sequence
  derived and/or modified CDS sequence (opt3) from HTNV(LongquanAa-09-171)__JQ912824.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagcccccaucuacgugccuacccuggacgauuuuagaagcauggaagcguucagugggauuuuuaggucuccacacggagaggaccacgaucuggccggugaagagaucgcauccuauagcaucgucggcccggcuaacgccaaagugccccauucggcaucuuccgacacacucucauuaauugcuuacagugggauaccuagcuauuccucucugagcauccuugccucaaguacugaagcgaagcacguauucuccccaggauuuuucccccaguugaaucauaccaaaugcgauaagacagccauuccucugaccuggacgggcaugaucgaccuaccagguuacuacgaggcaauacaccccuguacuguuuucugcgugcucagcgggccgggagcuucuugugaggccuuuucagaaggcggcauuuucaacaucacaaguccuaugugccuggucagcaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucccucuuuucucuguuacccggugucgcucacucgauugccguggaacugugcguuccaggcuuccaugggugggcaaccgccgcucuccuugugacauuuuguuucggauggguccugaucccugcguugacucuaaucauucugaccauacucaaauuuaucgcaaauauuuuccacacaaacaaucaggagaaccggcuuaagagcgugcugcgcaaaaucaaggaagaguuugagaaaacuaagggcuccaugguaugcgacguguguaaguaugaaugcgagaccuacaaagaacugaaggcccaugguguuucaugcccccagagucaauguccauauugcuucacacacugugagcccaccgaagcugccuuucaggcacauuaccgagucugccaggugacucacagauucagggaugacuugaaaaagacggugacaccucagaauuucaccccaggguguuaucggacucucaaccuguuucguuacaaaucucgcugcuacauuuucaccaugugggucuguuuacugguucuagagagcauccucugggccgcuuccgccucagaggugccgcugaaucccguguggaacgauaaugcacacggcguaggaagcgucccuaugcauacagaccuugaauuggauuuuucucugaccuccaguagcaaguauacuuacagaaggcggcucacaaacccacuggaggaaacgcaaucuauaaaucuucacaucgagauugaggaacagaccaucggcguggacguucaugcgcuggggcacugguucgauggacgauugaaccucaagacuuccuuucacugcuauggugcuuguacaaaauacgaguaucccuggcauaccgccaagugccacuacgaacgcgacuaucaguacgagacaucauggggcuguaauccugcagauugcccaggggugggaacuggcugcaccgccuguggucuguacuuagaccagcugaaacccgucgggagugcuuauaagauuaucacgauaagauacagcaggaaagugugcguucaauucggcgaagagaaccuauguaaggugauugacaugaaugauugcuuuguaacccggcaugucaagguguguaucauuggaacagugucgaaauucucccagggcgacacucuccuguuuuucgggccgcuugagggagguggcuugaucuuuaagcacuggugcaccucuacaugucaguucggggauccuggagacauaaugagcccacgcgauaaaggcuuucugugccccgaguucccugguucauucagaaagaaauguaacuuugccacuacgccccucugcgaguaugacgggaacauggucaguggcuacaagaaaguuauggcaaccaucgauuccuuccagucuuuuaauacaagcaccaugcauuucacugacgaaaggauugaguggaaggauccagacggaaugcugcgugaucacaucaacauuuuagugacaaaggacaucgauuuugacaaucugggcgaaaacccuuguaaaauagggcuucaaaccuccucaauugagggagcuuggggcagcgguguaggguucacuuugaccugccucaucagucugacagagugccccacguuucuaaccucuaucaaggccugugacaaagcgauuugcuauggagccgaauccgugacucugacacggggccagaauaccgucaaggugagcgguaaaggcgggcacucgggaucaacauucaaguguugccauggcgaggaauguucucagaucgggcuccacgcugcagccccacaucuggauaagguuaacggaauuagugagauagaaaauaacaaaguguacgacgauggcgcuccgcaaugcggugucaaguguugguuugugaaauccggggaguggaucagcggaauuuucucuggcaauuggaucguucuuauuguguugugcgucuuucuguuauucagccucguacugcuuuccgugcuguguccuguucgaaagcacaaaaagucauga

SEQ ID NO: 10061 - RNA, 3408 nt, Artificial Sequence
  derived and/or modified CDS sequence (opt3) from HTNV(LongquanAa-09-191)__JQ912825.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaaggaugccguuggcagauacugcccagaugguccccgagucaaguuguaacauggacaaucaucaaagcaugaacacgaucaccaaguacacacagguguccuggcggggaaaagcggaucaggcucaggccucucaaaauucguucgaagcaguuucagccgagguggacuuaaaggguacuugcguccugaaacacaagaugcuagaggaaagcuaucgcagucgaaaguccauuaccuguuacgaucucucuugcaacagcacauauuguaaaccuacccuguacaugaucgugccaauucaugcuugcaauaugaugaaguccugucuuaucgcacugggccccuaucguguacagguuguguacgagagaacuuacugcaugacaggggucuugauagaaggaaaauguuuugugccugaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagccccaaucuacgugcccacccuggacgauuuuaggagcauggaagcguucagugggauuuuucggucuccucacggagaggaccacgaucuggccggugaagagaucgccuccuauagcaucgucggcccagcuaacgccaaagugccgcauucggcaucuuccgacacacucucauuaauugcuuacagugggauacccagcuauuccucucugagcauccuugccucaaguacugaagcgaagcacguauucuccccuggauuuuucccacaguugaaucauaccaaaugcgauaagacagccauuccccugaccuggacgggcaugaucgaccuaccugguuacuacgaggcaauacacccauguacuguuuucugcgugcucagcgggcccggagcuucuugugaggccuuuucagaaggcggcauuuucaacaucacaaguccgaugugccuggucagcaaacagaaucgcuuuagacuuaccgagcaacaggugaacuucgucugucagaggguggacauggauaucauuguuuauugcaacgggcaacggaaggugauccugacuaagacauugguaauuggacaguguauauacaccaucacgucccucuuuucucuguuaccuggugucgcucacucgauugccguggaacugugcguucccggcuuccaugggugggcaaccgccgcucuccuugugacauuuuguuucggauggguccugaucccagcguugacucuaaucauucugaccauacucaaauuuaucgcaaauauuuuccacacaagcaaccaggagaaucgccugaaguccgugcuucgaaaaaucaaggaagaguuugagaaaacuaagggcucaaugguaugcgacguguguaaguaugaaugcgagaccuacaaagaacugaaggcccaugguguuaguugcccucagucucaaugucccuauugcuucacacacugugagccaaccgaagcugccuuucaggcacauuacagagucugccaggugacucacagguuccgggaugacuugaaaaagacggugacaccccagaacuucaccccuggguguuaucguacucucaaucuguuucgcuacaaaagcagaugcuacauuuucaccaugugggucuguuuacugguucuagaguccauccucugggccgcuucagccagcgaggugccacugaacccgguguggaaugauaacgcacacggcguaggaucuguccccaugcauacagaccuugaauuggauuuuucccugaccaguagcucuaaguauacuuacaggcggcgacucacaaauccucuggaggaaacgcaauccauaaaccuucacaucgagauugaggaacagaccaucggcguggacguucaugcgcuggggcacugguucgauggacgcuugaaucucaagacuucauuucacugcuauggugcuuguacaaaauacgaguauccauggcauaccgccaagugccacuacgaaagagacuaucaguacgagacaaguuggggcuguaaccccgcagauugcccuggggugggaacuggcugcaccgccuguggucuguacuuagaccagcugaaaccagucgggagcgcuuauaagauuaucacgauaagguacucgcggaaagugugcguucaauucggcgaagagaaucuauguaaggugauugacaugaacgauugcuuuguaacccgccaugucaagguguguaucauuggaacaguguccaaauucucucagggcgacacucuccuguuuuucgggccccuugagggagguggcuugaucuuuaagcacuggugcaccagcacaugucaguucggggauccgggagacauaaugucaccuagagauaaaggcuuucugugcccagaguuccccgguaguuucaggaagaaauguaauuuugccacuaccccucucugcgaguaugacgggaacauggucuccggcuacaagaaaguuauggcaacgaucgauucuuuccagagcuuuaacacauccaccaugcauuucacugacgaacguauugaguggaaggaucccgacggaaugcugcgggaucacaucaauauuuuagugacaaaggacaucgauuuugacaaccugggcgaaaauccauguaaaauagggcuucaaaccucaagcauugagggagcuuggggcagugguguaggguucacuuugaccugccucaucucucugacagagugcccuacguuucuaaccuccaucaaggccugugacaaagcgauuugcuauggagccgaaagcgugacucugacacgaggccagaacaccgucaaggugucggguaaaggcgggcacucaggaucuacauucaaguguugccauggcgaggaauguagucagaucgggcuccacgcugcagcaccccaucuggauaagguuaauggaauuuccgagauagaaaacaauaaaguguacgacgauggcgcuccacaaugcggugucaaguguugguuugugaaaagcggggaguggaucucuggaauuuucagcggcaacuggaucguucuuauuguguugugcgucuuucuguuauucucccucguacugcuuucagugcuguguccgguuagaaagcacaaaaagaguuga

SEQ ID NO: 10062 - RNA, 3408 nt, Artificial Sequence
  derived and/or modified CDS sequence (opt3) from HTNV(LongquanAa-09-350)__JQ912835.1__GP
auggagaucuggaaguggcuggugauggccagccucgucuggcccgcuuucaccagaaggaacguuuacgacaugaaaauugaaugcccucacacaguguccuuuggcgaaaauucuguaauaggguauguggaacuuccaccgaugccccuggcagauacugcccagauggucccugagucaaguuguaacauggacaaucaucaaagcaugaacacgaucaccaaguacacacagguguccuggcggggaaaagcggaucaggcucaggccucucaaaauucguucgaagcaguuucagccgagguggacuugaaggguacuugcgucuuaaaacacaagaugcuggaggaaagcuaucgcagucgaaaguccauuaccuguuacgaucuaucuugcaacagcacauauuguaaaccaacccucuacaugaucgugcccauucaugcuugcaauaugaugaaguccugucugaucgcacuuggcccuuaucguguacagguuguguacgagagaacuuacugcaugacagggguccugauagaaggaaaauguuuugugccagaccagucaguggucaguaucauuaagcacggcaucuucgauauugccagcguucauaucgugugcuuuuucguagcugugaaagguaacaccuauaaguuguuugagcaggucaagaaaucuuuccaauccacguguaaugggacugagaacaaggugcagggauacuauauaugcauuguuggcggcaauucagcccccaucuacgugccuacccucgacgauuuuaggagcauggaagcguucagugggauuuuucggucuccacacggagaggaccacgaucuggccggugaagagaucgcauccuauagcaucgucggcccggcuaacgccaaagugccccauucggcaucuuccgacacacugucacucauugcuuacagugggauaccuagcuauuccucuuuaagcauccuggccucaaguacugaagcgaagcacguauucuccccaggauuuuucccccagcuuaaucauaccaaaugcgauaagacagccauuccuuugaccuggacgggcaugaucgaccugccagguuacuacgaggcaauacaccccuguacuguuuucugcgugcuaagcgggccgggagcuucuugugaggccuuuucagaaggcggcauuuucaacaucacaaguccuaugugccucgucagcaaacagaaucgcuuuagacugaccgagcaacaggugaacuucgucugucagaggguggacauggauaucauuguuuauugcaacgggcaacggaaggugauccuuacuaagacacugguaauuggacaguguauauacaccaucacguccuuguuuucucuccugcccggugucgcucacucgauugccguggaauuaugcguuccaggcuuccaugggugggcaaccgccgcucugcucgugacauuuuguuucggauggguccuuaucccugcgcugacuuugaucauucuaaccauacugaaauuuaucgcaaauauuuuccacacaagcaaccaggagaaucgccucaaguccgugcugcgaaaaaucaaggaagaguuugagaaaacuaagggcucaaugguaugcgacguguguaaguaugaaugcgagaccuacaaagaacuuaaggcccaugguguuaguugcccccagucucaauguccauauugcuucacacacugugagcccaccgaagcugccuuucaggcacauuacagagucugccaggugacucacagguuccgggaugaccugaaaaagacggugacaccucagaacuucaccccaggguguuaucguacuuugaaucucuuucgcuacaaaagcagaugcuacauuuucaccaugugggucugucuguuaguucuggaguccauccuaugggccgcuucagccagcgaggugccgcucaaccccguguggaaugauaacgcacacggcguaggaucugucccuaugcauacagaccuggaacuugauuuuuccuugaccaguagcucuaaguauacuuacaggcggcgacugacaaauccacucgaggaaacgcaauccauaaaccugcacaucgagauugaggaacagaccaucggcguggacguucaugcgcuugggcacugguucgauggacgccugaauuugaagacuucauuucacugcuauggugcuuguacaaaauacgaguaucccuggcauaccgccaagugccacuacgaaagagacuaucaguacgagacaaguuggggcuguaacccugcagauugcccaggggugggaacuggcugcaccgccuguggucucuaccuggaccaguuaaaacccgucgggagcgcuuauaagauuaucacgauaagguacucgcggaaagugugcguucaauucggcgaagagaaucuguguaaggugauugacaugaacgauugcuuuguaacccgccaugucaagguguguaucauuggaacaguguccaaauucucucagggcgacacucuacucuuuuucgggccgcuggagggagguggccuuaucuuuaagcacuggugcaccagcacaugucaguucggggauccuggagacauaaugucaccaagagauaaaggcuuuuugugccccgaguucccugguaguuucaggaagaaauguaauuuugccacuacgccccugugcgaguaugacgggaacauggucuccggcuacaagaaaguuauggcaaccaucgauucuuuccagagcuuuaacacauccaccaugcauuucacugacgaacguauugaguggaaggauccagacggaaugcuccgggaucacaucaauauucuggugacaaaggacaucgauuuugacaacuuaggcgaaaauccuuguaaaauagggcugcaaaccucaagcauugagggagcuuggggcagugguguaggguucacucuuaccugcuugaucucucucacagagugccccacguuucugaccuccaucaaggccugugacaaagcgauuugcuauggagccgaaagcgugacucuaacacgaggccagaacaccgucaaggugucggguaaaggcgggcacucaggaucuacauucaaguguugccauggcgagaaguguagucagaucgggcugcacgcugcagccccacaucucgauaaaguuaauggaauuuccgaaauagagaacaauaagguguacgacgauggcgcuccgcaaugcggugucaaauguugguuuguuaagagcggggaauggaucucuggaauuuucagcggcaacuggaucgugcugauugugcuuugcgucuuuuugcuguucuccuuaguacuccugucagugcuuuguccuguuagaaaacacaagaagaguuga

SEQ ID NO: 10063 - RNA, 3408 nt, Artificial Sequence
  derived and/or modified CDS sequence (opt3) from HTNV(LongquanAa-09-489)__JQ912844.1__GP
auggagaucuggaaguggcuggugauggccagccucgucuggcccgcuuucacccuuagaaacguuuacgacaugaaaauugaaugcccucacacaguguccuuuggcgagaauagcguaauaggguauguggaacugccaaggaugccguuggcagauacugcccagaugguccccgagucaaguuguaacauggacaaucaucaaagcaugaacacgaucaccaaguacacacagguguccuggcggggaaaagcggaucaggcucaggccucucaaaauucguucgaagcaguuucagccgagguggacuuaaaggguacuugcguccugaaacacaagaugcuagaggaaagcuaucgcagucgaaaguccauuaccuguuacgaucucucuugcaacagcacauauuguaaaccuacccuguacaugaucgugccaauucaugcuugcaauaugaugaaguccugucuuaucgcacugggccccuaucguguacagguuguguacgagagaacuuacugcaugacaggggucuugauagaaggaaaauguuuugugccugaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagccccaaucuacgugcccacccuggacgauuuuaggagcauggaagcguucagugggauuuuucggucuccucacggagaggaccacgaucuggccggugaagagaucgccuccuauagcaucgucggcccagcuaacgccaaagugccgcauucggcaucuuccgacacacucucauuaauugcuuacagugggauacccagcuauuccucucugagcauccuugccucaaguacugaagcgaagcacguauucuccccuggauuuuucccacaguugaaucauaccaaaugcgauaagacagccauuccccugaccuggacgggcaugaucgaccuaccugguuacuacgaggcaauacacccauguacuguuuucugcgugcucagcgggcccggagcuucuugugaggccuuuucagaaggcggcauuuucaacaucacaaguccgaugugccuggucagcaaacagaaucgcuuuagacuuaccgagcaacaggugaacuucgucugucagaggguggacauggauaucauuguuuauugcaacgggcaacggaaggugauccugacuaagacauugguaauuggacaguguauauacaccaucacgucccucuuuucucuguuaccuggugucgcucacucgauugccguggaacugugcguucccggcuuccaugggugggcaaccgccgcucuccuugugacauuuuguuucggauggguccugaucccagcguugacucuaaucauucugaccauacucaaauuuaucgcaaauauuuuccacacaagcaaccaggagaaucgccugaaguccgugcuucgaaaaaucaaggaagaguuugagaaaacuaagggcucaaugguaugcgacguguguaaguaugaaugcgagaccuacaaagaacugaaggcccaugguguuaguugcccucagucucaaugucccuauugcuucacacacugugagccaaccgaagcugccuuucaggcacauuacagagucugccaggugacucacagguuccgggaugacuugaaaaagacggugacaccccagaacuucaccccuggguguuaucguacucucaaucuguuucgcuacaaaagcagaugcuacauuuucaccaugugggucuguuuacugguucuagaguccauccucugggccgcuucagccagcgaggugccacugaacccgguguggaaugauaacgcacacggcguaggaucuguccccaugcauacagaccuucaauuggauuuuucccugaccaguagcucuaaguauacuuacaggcggcgacucacaaauccucuggaagagacgcaguccauaaaccuucacaucgaaauugaggagcagaccaucggcguggacguucaugcgcuggggcacugguucgauggacgcuugaaucucaagacuucauuucacugcuauggugcuuguacaaaauacgaauauccauggcauaccgccaagugccacuacgagagagacuaucaguacgaaacaaguuggggcuguaaccccgcagauugcccuggggugggaacuggcugcaccgccuguggucuguacuuagaccaacugaaaccagucgggagcgcuuauaagauuaucacgauaagguacucgcggaaagugugcguucaguucggcgaggaaaaucuauguaaggugauugacaugaacgauugcuuuguaacccgccaugucaagguguguaucauuggaacaguguccaaauucucucagggcgacacucuccuguuuuucgggccccuugagggagguggcuugaucuuuaagcacuggugcaccagcacaugucaguucggggauccgggagacauaaugucaccuagagauaaaggcuuucugugcccagaguuccccgguaguuucaggaagaaauguaauuuugccacuaccccucucugcgaauaugacgggaacauggucuccggcuacaagaaaguuauggcaacgaucgauucuuuccaaucuuuuaacacauccaccaugcauuucacugacgagcguauugaauggaaggaucccgacggaaugcugcgggaucacaucaauauuuuagugacaaaggacaucgauuuugacaaccugggcgagaauccauguaaaauagggcuucagaccucaagcauugaaggagcuuggggcagugguguaggguucacuuugaccugccucaucucucugacagagugcccuacguuucuaaccuccaucaaggccugugacaaagcgauuugcuauggagccgagagcgugacucugacacgaggccagaacaccgucaaggugucggguaaaggcgggcacucaggaucuacauucaaguguugccauggcgaagaguguagucaaaucgggcuccacgcugcagcaccccaucuggauaagguuaauggaauuuccgaaauagagaacaauaaaguguacgacgauggcgcuccacagugcggugucaaguguugguuugugaaaagcggggaauggaucucuggaauuuucagcggcaacuggaucguucuuauuguguugugcgucuuucuguuauucucccucguacugcuuucagugcuguguccgguuagaaagcacaaaaagaguuga

SEQ ID NO: 10064 - RNA, 3408 nt, Artificial Sequence
  derived and/or modified CDS sequence (opt3) from HTNV(LongquanAa-09-541)__JQ912850.1__GP
augggcaucuggaaguggcuggugauggccagccucgucuggcccgcuuucacccuuagaaacguuuacgacaugaaaauugagugcccucacacaguguccuuuggggaaaauucuguaauaggauauguggagcugccaccgaugcccuuggcagauacugcccagauggucccugaaucaaguuguaacauggacaaucaucaaagcaugaacacgaucaccaaguacacacagguguccuggagggguaaagcggaucaggcucaggccucucaaaauucguucgaggcaguuucagccgaaguggacuuaaagggcauuugcguccugaaacacaagaugcuagaggagagcuaucggagucgcaaguccaucacuuguuacgaucucucuugcaacagcaccuauuguaaaccaacacuguacaugauugugcccauccaugcuugcaauaugaugaaguccugucuuauagcacuggggccuuaucgaguacagguuguguacgaacguaccuacugcaugacuggagucuugcucgagggcaaauguuuugugccagaccagucaguggucaguaucauuaagcacgguaucuucgauauugccagcguucauaucgugugcuuuuucguagcugugaaagggaacacauauaagcuguuugaacaggucaagaaaucuuuccaauccaccuguaauggaacggagaacaaggugcagggcuacuauauaugcauuguuggcgggaauagugcccccaucuacgugccuacucuggacgauuuuagaagcauggaggcguucaguggaauuuuuaggucuccacacggugaagaccacgaucucgcaggcgaggaaaucgccuccuauagcaucgucgggccggcuaacgccaaagugccccauucggcaucuuccgacaccuuaucacugauugcuuacaguggaauaccuagcuauuccucucuuagcaucuuggccucaaguacagaggcgaagcacguauucuccccaggcuuuuucccccagcugaaucauacuaaaugcgauaagaccgccauuccucuaacauggaccgguaugaucgaccucccaggguacuacgaagcaauacaccccuguacgguuuucugcgugcugagcggaccgggcgcuucuugugaggccuuuucagagggcgggauuuucaacaucacuucaccuaugugccuugucagcaaacagaaucgguuucgccugacagaacaacaggugaacuucgucugucagagaguggacauggauaucauuguuuauugcaacggacaaaggaaggugaucuugaccaagacucucguaauuggucaguguauauacacaaucaccucccuguuuucuuuacugcccggcgucgcucacucgauugccguggagcucugcguuccaggguuccauggaugggcaacggccgcgcuucuggugaccuuuuguuucggcugggucuugaucccugcucuaacacugaucauucucacuauacugaaauuuaucgcaaauauuuuccacaccagcaaccaggaaaaucggcuuaaguccgugcugcgcaaaaucaaggaggaauuugagaaaacaaaggguucaaugguaugcgacguguguaaguaugagugcgaaacuuacaaagaguugaaggcccaugggguuaguugcccccagucucaauguccauauugcuucacccacugugaacccacagaggcugccuuucaggcacauuaccgagucugccaggugacccacagauucagggaugaccucaaaaagacugugacgccucagaacuucacaccaggcuguuaucggacccugaauuuauuucguuacaaaagccgcugcuacauuuucacuaugugggucugucugcuaguucucgaauccauccugugggccgcuucagccagcgaggugccgcuuaaccccguguggaaugauaacgcacacggaguaggcucugucccuaugcauaccgacuuggagcuggauuuuucccucacaaguagcucuaaguauaccuacagaaggcggcugacuaauccacuugaagagacacaauccauaaaccugcacaucgaaauugaggagcagacgaucgggguggacguucaugcguugggacacugguucgauggucgacucaaucugaagaccucauuucacugcuauggcgcuuguacuaaauacgaauaucccuggcauacagccaagugccacuacgagcgcgacuaucaguacgaaaccaguuggggguguaacccugcagauugcccaggagugggcacagguugcacugccuguggguuauaccuggaccagcuaaaacccgucggcagcgcuuauaagauuaucaccauaagauacucgaggaaagugugcguucaauucggagaggaaaaucucuguaaggugauugacaugaacgauugcuuuguaacgcggcaugucaagguguguaucauuggcaccguguccaaauucucucagggggacacacuguuguuuuucggaccgcuugaggguggcgggcugaucuuuaagcacuggugcacuagcaccugucaguucggagauccuggcgacauaaugucaccacgcgauaaagguuuucucugccccgaguucccugggaguuucagaaagaaauguaauuuugccacaacuccccugugcgaauaugacggcaacauggucuccggauacaagaaaguuauggcaaccaucgauucuuuccagagcuuuaacacguccacaaugcauuucaccgacgagaggauugaauggaaggauccagacggcauguuacgugaucacaucaauauucuggugacuaaggacaucgauuuugacaaccuuggggagaauccuuguaaaauaggauugcaaacaucaagcauugaaggcgcuugggguagugggguaggauucacccucacuugccugaucucucuaaccgagugccccacauuucugacguccaucaaggccugugacaaagcgauuugcuauggcgccgagagcgugacccucacucggggucagaacacagucaaggugucgggcaaagggggacacucaggcucuaccuucaaguguugccauggggaagaguguagucagaucggacugcacgcugcagccccacaucuugauaagguuaauggcauuuccgaaauagagaacaauaaaguguacgacgauggugcuccgcaaugcggggucaaguguugguuugugaaaagcggagaauggaucucuggcauuuucagcgguaacuggaucguuuugauugugcugugcgucuuuuuacucuucucccugguacuucugucaguguuguguccuguucgaaagcacaaaaagaguuga

SEQ ID NO: 10065 - RNA, 3408 nt, Artificial Sequence
  derived and/or modified CDS sequence (opt3) from HTNV(LongquanAa-09-698)__JQ912854.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcauucugaaacacaagaugcuagaggaaagcuaucggagucgcaaguccaucaccuguuacgaucucucuugcaacagcacauauuguaaaccaacccuguacaugauuguccccauccaugcuugcaauaugaugaaguccugucuuauagcacugggcccuuaucgagugcagguaguuuacgagcguacuuacugcaugacagggguguugaucgaaggaaaauguuuugucccagaccagucaguggugaguauuaucaagcacggcauuuucgauaucgccagcguccauauaguuugcuuuuucguggcuguaaaagguaacaccuauaagcucuuugaacaggugaagaaaucuuuccaauccacguguaaugggacugagaacaagguccagggauacuauauuugcaucgugggcggcaauucagcccccauuuacguuccuacccuggacgauuuuagaagcauggaggcguucagugggaucuuuaggucuccacacggagaggaccacgaucuggccggugaagagaucgcauccuauagcauugugggcccggcuaacgccaaagucccccauucggcaucuuccgacacacucucauuaauagcuuacagugggaucccuagcuauuccucucugagcauucuugccucaaguacugaagcgaagcacguguucuccccaggauuuuucccccaguugaaucauaccaaaugcgauaagacagccaucccucugaccuggacgggcaugauagaccuaccagguuacuacgaggcaauucaccccuguacuguauucugcguucucagcgggccgggagcuucuugugaggccuuuucagaaggcggcaucuucaacaucacaaguccuaugugccuggugagcaaacagaaucgguuucgccuuaccgagcaacaggucaacuucgugugucagagagucgacauggauauuaucguguauugcaacgggcaaaggaagguuauucugacuaagacauuggugauaggacaguguaucuacaccauuacgucccucuuuucucuguuacccgguguagcucacucgaucgccgucgaacugugcgugccaggcuuccaugggugggcaaccgccgcucuccuuguuacauuuuguuucggaugggugcugaucccugcguugacucuaauuauacugaccauccucaaauuuauugcaaauaucuuccacacaagcaaccaggagaaucggcugaaguccguccuucgcaaaauuaaggaagaguuugagaaaacuaagggcucaauggugugcgacguauguaaguaugaaugcgagaccuacaaagaacugaaggcccauggugugaguugcccccagucucaauguccauauugcuucacacacugugagcccaccgaagcugccuuucaggcacauuaccgaguuugccaggucacucacagauucagggaugacuugaaaaagacggugacaccucagaacuucaccccaggguguuaucggacucucaaucuguuucguuacaaaagccgcugcuacaucuucaccauguggguguguuuacugguccuagaguccauacucugggccgcuucagccagcgagguuccgcugaaccccguguggaaugauaacgcacacggcgugggaucuguaccuaugcauacagaccuugaauuggauuuuucccugaccaguagcucuaaguauacuuacagaaggcggcucacaaauccacuggaggaaacgcaauccaucaaccuucacauugagaucgaggaacagaccauuggcgucgacgugcaugcgcuggggcacugguucgauggacgauugaaucucaagacuucauuucacugcuauggugcuuguacaaaauacgaguaucccuggcauaccgccaagugccacuacgaacgcgacuaucaguacgagacaaguuggggcuguaacccugcagauugcccagggguuggaacuggcugcaccgccuguggucuguacuuagaccagcugaaacccguggggagcgcuuauaagaucauaacgauuagauacucgaggaaagucugcgugcaauucggcgaagagaaucuauguaagguuaucgacaugaacgauugcuuugugacccggcauguaaaggucuguauuaucggaacaguguccaaauucucucagggcgacacucuccuguuuuucgggccgcuugagggagguggcuugauauuuaagcacuggugcaccagcacaugucaguucggggauccuggagacaucaugucaccacgcgauaaaggcuuucugugccccgaguucccugguaguuucagaaagaaauguaauuuugccacuacgccccucugcgaguaugacgggaacaugguguccggcuacaagaaagucauggcaaccauugauucuuuccagagcuuuaacacauccaccaugcauuucacugacgaaaggaucgaguggaaggauccagacggaaugcugcgugaucacauuaauaucuuaguuacaaaggacauagauuuugacaaccugggcgaaaauccuuguaaaauugggcuucaaaccucaagcaucgagggagcuuggggcaguggugugggguucacuuugaccugccucaucucucugacagagugccccacguuucuaaccuccauuaaggccugugacaaagcgaucugcuauggagccgaaagcguaacucugacacggggccagaacaccgugaaggucucggguaaaggcgggcacucaggaucuacauucaaguguugccauggcgaggaauguagucagauugggcuccacgcugcagccccacaucuggauaaggugaauggaauauccgagaucgaaaacaauaaaguuuacgacgauggcgcuccgcaaugcggugugaaguguugguuugucaaaagcggggaguggauuucuggaaucuucagcggcaacuggauugugcuuaucguuuugugcguguuucuguuauucucccucguccugcuuucaguacuguguccugugcgaaagcacaaaaagaguuga

SEQ ID NO: 10066 - RNA, 3408 nt, Artificial Sequence
  derived and/or modified CDS sequence (opt3) from HTNV(LongquanAa-10-393)__JQ912859.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagcccccaucuacgugccuacccuggacgauuuuagaagcauggaagcguucagugggauuuuuaggucuccacacggagaggaccacgaucuggccggugaagagaucgcauccuauagcaucgucggcccggcuaacgccaaagugccccauucggcaucuuccgacacacucucauuaauugcuuacagugggauaccuagcuauuccucucugagcauccuugccucaaguacugaagcgaagcacguauucuccccaggauuuuucccccaguugaaucauaccaaaugcgauaagacagccauuccucugaccuggacgggcaugaucgaccuaccagguuacuacgaggcaauacaccccuguacuguuuucugcgugcucagcgggccgggagcuucuugugaggccuuuucagaaggcggcauuuucaacaucacaaguccuaugugccuggucagcaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucccucuuuucucuguuacccggugucgcucacucgauugccguggaacugugcguuccaggcuuccaugggugggcaaccgccgcucuccuugugacauuuuguuucggacggguccugaucccugcguugacucuaaucauucugaccauacucaaauuuaucgcaaauauuuuccacacaagcaaccaggagaaucgccugaaguccgugcuucgaaaaaucaaggaagaguuugagaaaacuaagggcucaaugguaugcgacguguguaaguaugaaugcgagaccuacaaagaacugaaggcccaugguguuaguugcccccagucucaauguccauauugcuucacacacugugagcccaccgaagcugccuuucaggcacauuacagagucugccaggugacucacagguuccgggaugacuugaaaaagacggugacaccucagaacuucaccccaggguguuaucguacucucaaucuguuucgcuacaaaagcagaugcuacauuuucaccaugugggucuguuuacugguucuagaguccauccucugggccgcuucagccagcgaggugccgcugaaccccguguggaaugauaacgcacacggcguaggaucugucccuaugcauacagaccuugaauuggauuuuucccugaccaguagcucuaaguauacuuacaggcggcgacucacaaauccacuggaggaaacgcaauccauaaaccuucacaucgagauugaggaacagaccaucggcguggacguucaugcgcuggggcacugguucgauggacgcuugaaucucaagacuucauuucacugcuauggugcuuguacaaaauacgaguaucccuggcauaccgccaagugccacuacgaaagagacuaucaguacgagacaaguuggggcuguaacccugcagauugcccaggggugggaacuggcugcaccgccuguggucuguacuuagaccagcugaaacccgucgggagcgcuuauaagauuaucacgauaagguacucgcggaaagugugcguucaauucggcgaagagaaucuauguaaggugauugacaugaacgauugcuuuguaacccgccaugucaagguguguaucauuggaacaguguccaaauucucucagggcgacacucuccuguuuuucgggccgcuugagggagguggcuugaucuuuaagcacuggugcaccagcacaugucaguucggggauccuggagacauaaugucaccaagagauaaaggcuuucugugccccgaguucccugguaguuucaggaagaaauguaauuuugccacuacgccccucugcgaguaugacgggaacauggucuccggcuacaagaaaguuauggcaaccaucgauucuuuccagagcuuuaacacauccaccaugcauuucacugacgaacguauugaguggaaggauccagacggaaugcugcgggaucacaucaauauuuuagugacaaaggacaucgauuuugacaaccugggcgaaaauccuuguaaaauagggcuucaaaccucaagcauugagggagcuuggggcagugguguaggguucacuuugaccugccucaucucucugacagagugccccacguuucuaaccuccaucaaggccugugacaaagcgauuugcuauggagccgaaagcgugacucugacacgaggccagaacaccgucaaggugucggguaaaggcgggcacucaggaucuacauucaaguguugccauggcgaggaauguagucagaucgggcuccacgcugcagccccacaucuggauaagguuaauggaauuuccgagauagaaaacaauaaaguguacgacgauggcgcuccgcaaugcggugucaaguguugguuugugaaaagcggggaguggaucucuggaauuuucagcggcaacuggaucguucuuauuguguugugcgucuuucuguuauucucccucguacugcuuucagugcuguguccuguuagaaagcacaaaaagaguuga

SEQ ID NO: 10067 - RNA, 3408 nt, Artificial Sequence
  derived and/or modified CDS sequence (opt3) from HTNV(LongquanAa-10-58)__JQ912861.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagcccccaucuacgugccuacccuggacgauuuuagaagcauggaagcguucagugggauuuuuaggucuccacacggagaggaccacgaucuggccggugaagagaucgcauccuauagcaucgucggcccggcuaacgccaaagugccccauucggcaucuuccgacacacucucauuaauugcuuacagugggauaccuagcuauuccucucugagcauccuugccucaaguacugaagcgaagcacguauucuccccaggauuuuucccccaguugaaucauaccaaaugcgauaagacagccauuccucugaccuggacgggcaugaucgaccuaccagguuacuacgaggcaauacaccccuguacuguuuucugcgugcucagcgggccgggagcuucuugugaggccuuuucagaaggcggcauuuucaacaucacaaguccuaugugccuggucagcaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucccucuuuucucuguuacccggugucgcucacucgauugccguggaacugugcguuccaggcuuccaugggugggcaaccgccgcucuccuugugacauuuuguuucggauggguccugaucccugcguugacucuaaucauucugaccauacucaaauuuaucgcaaauauuuuccacacaagcaaccaggagaaucggcugaaguccgugcuucgcaaaaucaaggaagaguuugagaaaacuaagggcucaaugguaugcgacguguguaaguaugaaugcgagaccuacaaagaacugaaggcccaugguguuaguugcccccagucucaauguccauauugcuucacacacugugagcccaccgaagcugccuuucaggcacauuaccgagucugccaggugacucacagauucagggaugacuugaaaaagacggugacaccucagaacuucaccccaggguguuaucggacucucaaucuguuucguuacaaaagccgcugcuacauuuucaccaugugggucuguuuacugguucuagaguccauccucugggccgcuucagccagcgaggugccgcugaaccccguguggaaugauaacgcacacggcguaggaucugucccuaugcauacagaccuugaauuggauuuuucccugaccaguagcucuaaguauacuuacagaaggcggcucacaaauccacuggaggaaacgcaauccauaaaccuucacaucgagauugaggaacagaccaucggcguggacguucaugcgcuggggcacugguucgauggacgauugaaucucaagacuucauuucacugcuauggugcuuguacaaaauacgaguaucccuggcauaccgccaagugccacuacgaacgcgacuaucaguacgagacaaguuggggcuguaacccugcagauugcccaggggugggaacuggcugcaccgccuguggucuguacuuagaccagcugaaacccgucgggagcgcuuauaagauuaucacgauaagauacucgaggaaagugugcguucaauucggcgaagagaaucuauguaaggugauugacaugaacgauugcuuuguaacccggcaugucaagguguguaucauuggaacaguguccaaauucucucagggcgacacucuccuguuuuucgggccgcuugagggagguggcuugaucuuuaagcacuggugcaccagcacaugucaguucggggauccuggagacauaaugucaccacgcgauaaaggcuuucugugccccgaguucccugguaguuucagaaagaaauguaauuuugccacuacgccccucugcgaguaugacgggaacauggucuccggcuacaagaaaguuauggcaaccaucgauucuuuccagagcuuuaacacauccaccaugcauuucacugacgaaaggauugaguggaaggauccagacggaaugcugcgugaucacaucaauauuuuagugacaaaggacaucgauuuugacaaccugggcgaaaauccuuguaaaauagggcuucaaaccucaagcauugagggagcuuggggcagugguguaggguucacuuugaccugccucaucucucugacagagugccccacguuucuaaccuccaucaaggccugugacaaagcgauuugcuauggagccgaaagcgugacucugacacggggccagaacaccgucaaggugucggguaaaggcgggcacucaggaucuacauucaaguguugccauggcgaggaauguagucagaucgggcuccacgcugcagccccacaucuggauaagguuaauggaauuuccgagauagaaaacaauaaaguguacgacgauggcgcuccgcaaugcggugucaaguguugguuugugaaaagcggggaguggaucucuggaauuuucagcggcaacuggaucguucuuauuguguugugccuguuuuuacucuucucccugguccuucugucaguauuguguccugugcgaaagcacaaaaagaguuga

SEQ ID NO: 10068 - RNA, 3408 nt, Artificial Sequence
  derived and/or modified CDS sequence (opt3) from HTNV(LongquanAa-10-74)__JQ912864.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagcccccaucuacgugccuacccuggacgauuuuagaagcauggaagcguucagugggauuuuuaggucuccacacggagaggaccacgaucuggccggugaagagaucgcauccuauagcaucgucggcccggcuaacgccaaagugccccauucggcaucuuccgacacacucucauuaauugcuuacagugggauaccuagcuauuccucucugagcauccuugccucaaguacugaagcgaagcacguauucuccccaggauuuuucccccaguugaaucauaccaaaugcgauaagacagccauuccucugaccuggacgggcaugaucgaccuaccagguuacuacgaggcaauacaccccuguacuguuuucugcgugcucagcgggccgggagcuucuugugaggccuuuucagaaggcggcauuuucaacaucacaaguccuaugugccuggucagcaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucccucuuuucucuguuacccggugucgcucacucgauugccguggaacugugcguuccaggcuuccaugggugggcaaccgccgcucuccuugugacauuuuguuucggauggguccugaucccugcguugacucuaaucauucugaccauacucaaauuuaucgcaaauauuuuccacacaagcaaccaggagaaucggcugaaguccgugcuucgcaaaaucaaggaagaguuugagaaaacuaagggcucaaugguaugcgacguguguaaguaugaaugcgagaccuacaaagaacugaaggcccaugguguuaguugcccccagucucaauguccauauugcuucacacacugugagcccaccgaagcugccuuucaggcacauuaccgagucugccaggugacucacagauucagggaugacuugaaaaagacggugacaccucagaacuucaccccaggguguuaucggacucucaaucuguuucguuacaaaagccgcugcuacauuuucaccaugugggucuguuuacugguucuagaguccauccucugggccgcuucagccagcgaggugccgcugaaccccguguggaaugauaacgcacacggcguaggaucugucccuaugcauacagaccuugaauuggauuuuucccugaccaguagcucuaaguauacuuacagaaggcggcucacaaauccacuggaggaaacgcaauccauaaaccuucacaucgagauugaggaacagaccaucggcguggacguucaugcgcuggggcacugguucgauggacgauugaaucucaagacuucauuucacugcuauggugcuuguacaaaauacgaguaucccuggcauaccgccaagugccacuacgaacgcgacuaucaguacgagacaaguuggggcuguaacccugcagauugcccaggggugggaacuggcugcaccgccuguggucuguacuuagaccagcugaaacccgucgggagcgcuuauaagauuaucacgauaagauacucgaggaaagugugcguucaauucggcgaagagaaucuauguaaggugauugacaugaacgauugcuuuguaacccggcaugucaagguguguaucauuggaacaguguccaaauucucucagggcgacacucuccuguuuuucgggccgcuugagggagguggcuugaucuuuaagcacuggugcaccagcacaugucaguucggggauccuggagacauaaugucaccacgcgauaaaggcuuucugugccccgaguucccugguaguuucagaaagaaauguaauuuugccacuacgccccucugcgaguaugacgggaacauggucuccggcuacaagaaaguuauggcaaccaucgauucuuuccagagcuuuaacacauccaccaugcauuucacugacgaaaggauugaguggaaggauccagacggaaugcugcgugaucacaucaauauuuuagugacaaaggacaucgauuuugacaaccugggcgaaaauccuuguaaaauagggcuucaaaccucaagcauugagggagcuuggggcagugguguaggguucacuuugaccugccucaucucucugacagagugccccacguuucuaaccuccaucaaggccugugacaaagcgauuugcuauggagccgaaagcgugacucugacacggggccagaacaccgucaaggugucggguaaaggcgggcacucaggaucuacauucgaguguugccauggcgaagaguguagucagaucgggcuccacgcugcagccccacaucuggauaagguuaauggaauuuccgaaauagagaacaauaagguguacgacgauggcgcuccgcaaugcggugucaaauguugguuuguuaagagcggggaguggaucucuggaauuuucagcggcaacuggaucgugcuuauuguguugugcgucuuucuguuauucucccucguacugcuuucagugcuguguccuguucgaaaacacaagaaaaguuga

SEQ ID NO: 10069 - RNA, 3408 nt, Artificial Sequence
  derived and/or modified CDS sequence (opt3) from HTNV(LongquanAa-10-98)__JQ912866.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggagcugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcuccuggagcaggucaagaaaucuuuucaauccacguguaaugacacugagaacaaggugcagggguacuauauaugcauuguuggaggcaauucagcccccaucuacgugccuacccuggaugacuucagaagcauggaagcguuuaguggcauuuucaggucuccacacggggaggaucacgaccucgcaggagaagagaucgccuccuauagcaucgucgguccggcuaacgccaaagugccccauucggcaucuuccgauacauuaucacugauugcuuacaguggcauaccuagcuauuccucucuuagcaucuuggccucaaguacugaagcgaagcacguauuuuccccaggguucuuuccccagcugaaucauaccaaaugcgacaagacagccauuccucuaaccuggacgggaaugaucgaccucccaggcuacuacgaggcaauacaccccuguacuguuuucugcgugcugagcgguccgggggcuucuugugaggccuucucagaaggaggcauuuuuaacaucacaaguccuaugugccuugucagcaaacagaaucgguuccgccugaccgagcaacaggugaacuuugucugucagagaguggauauggacaucauuguuuauugcaacggccaaaggaaggugaucuugacuaagacacucguaauugggcaguguauauacaccaucacgucccuguucucuuuacugcccggagucgcucacucgauugccguggaacucugcguuccagguuuucauggcugggcaaccgccgcucuccuggugacauucuguuuugggugggucuugaucccugcgcuaacucugaucauucucaccauacugaaauucaucgcaaauauuuuucacacaagcaaccaggagaaucggcuuaaguccgugcugcgcaaaaucaaggaagaguucgagaaaacuaagggaucaaugguaugcgauguguguaaguaugaaugcgagaccuacaaagaauugaaggcccauggcguuaguugcccccagucucaauguccauauugcuuuacacacugugagcccaccgaagcugccuuccaggcacauuaccgagucugccaggugacucacagauuuagggacgaucucaaaaagacggugacaccucagaacuucaccccagguuguuaucggacucugaauuuauuccguuacaaaagccgcugcuacauuuuuaccaugugggucugucugcuaguucucgaguccauccugugggccgcuucagccagcgaggugccgcuuaaccccguguggaaugacaacgcacacgggguaggcucugucccuaugcauacagauuuggaacuggacuucucccucaccaguagcucuaaguauacuuacagaaggcggcugacaaauccacuugaggaaacgcaauccauaaaccugcacaucgagauugaggaacagaccaucggaguggauguucaugcguugggccacugguuugacgggcgacucaaucugaagacuucauuccacugcuauggagcuuguacaaaauacgaguaucccuggcauaccgccaagugccacuacgaacgcgauuaucaguacgagacaaguugggguuguaacccugcagacugcccaggcguggggacuggaugcaccgccuguggcuuauaccuggaccagcuaaaacccgucgguagcgcuuauaagauuaucacgauaagauacucgaggaaagugugcguucaauuuggggaagagaaucucuguaaggugauugauaugaacgacugcuucguaacccggcaugucaagguguguaucauuggcacaguguccaaauuuucucagggagauacucugcuuuucuuuggcccguuggaagggggaggucugaucuucaagcacuggugcaccagcacaugucaguuuggcgacccuggggauauaaugucaccacgcgacaaaggauuccucugccccgaguuuccuggcaguuucagaaagaaauguaauuucgccacuacgccccugugcgaguaugaugguaacauggucuccggguacaagaaaguuauggcaaccaucgacucuuuucagagcuucaacacauccaccaugcauuuuacugaugaaaggauugaguggaaggacccagauggcauguuacgugaccacaucaauauucuggugacaaaggauaucgacuucgacaaccuuggagaaaauccuuguaaaauaggcuugcaaaccucaagcauugagggggcuuggggaaguggcguagguuuuacucuuaccugccugaucucucuaacagagugccccacguuccugaccuccaucaaggccugugauaaagcgauuugcuauggggccgaaagcgugacucucacacggggacagaacaccgucaaggugucgggcaaagguggccacucagggucuacauuuaaguguugccauggagaggaauguagucagaucggccugcacgcugcagccccacaucuugacaagguuaaugggauuuccgagauagaaaacaauaaaguguacgaugacggagcuccgcaaugcggcgucaaguguugguucgugaaaagcggugaguggaucucugggauuuuuagcggaaacuggaucguuuugauugugcugugcgucuucuuacucuuuucccugguacuucugucaguguuguguccuguucgaaagcacaaaaagaguuga

SEQ ID NO: 10070 - RNA, 3408 nt, Artificial Sequence
  derived and/or modified CDS sequence (opt3) from HTNV(LongquanAa-11-452)__KC344264.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggagcugccaccgaugcccuuggcagauacugcccagauggucccugagucaaguuguaacauggacaaucaucaaagcaucaacacgauuaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccaucaccuguuacgaucucucuugcaacagcacauauuguaaaccaacccuguacaugauugugcccauccaugcuugcaauaugaugaaguccugucuuauagcacugggcccuuaucgaguacagguuguguacgagcguacuuacugcaugacaggggucuugaucgaaggaaaauguuuugugccagaccagucaguggucaguauuaucaagcacggcauuuucgauaucgccagcguucauauagugugcuuuuucguagcugugaaagguaacaccuauaagcuccuggagcaggucaagaaaucuuuucaauccacguguaaugacacugagaacaaggugcagggguacuauauuugcaucguuggaggcaauucagcccccauuuacgugccuacccuggaugacuucagaagcauggaagcguuuaguggcaucuucaggucuccacacggggaggaucacgaccucgcaggagaagagaucgccuccuauagcauuauagguccggcuaacgccaaagucccccauucggcaucuuccgauacauuaucacugaucgcuuacaguggcauuccuagcuauuccucucuuagcaucuuggccucaaguacugaagcgaagcacguguuuuccccaggguucuuuccccagcugaaucauaccaaaugcgacaagacagccauaccucuaaccuggacgggaaugauugaccucccaggcuacuacgaggcaauccaccccuguacuguauucugcguucugagcgguccgggggcuucuugugaggccuucucagaaggaggcaucuuuaacauuacaaguccuaugugccuugugagcaaacagaaucgguuccgccugaccgagcaacaggucaacuuugugugucagagagucgauauggacaucauuguguauugcaacggccaaaggaagguuauauugacuaagacacucgugaucgggcaguguauuuacaccaucacgucccuguucucuuuacugcccggaguagcucacucgaucgccgucgaacucugcgugccagguuuucauggcugggcaaccgccgcucuccugguuacauucuguuuuggguggguguugauuccugcgcuaacucugauaauccucaccauucugaaauucaucgcaaauauuuuucacacaagcaaccaggagaaucggcuuaaguccguccugcgcaaaaucaaggaagaguucgagaaaacuaagggaucaauggugugcgauguauguaaguaugaaugcgagaccuacaaagaauugaaggcccauggcgugaguugcccccagucucaauguccauauugcuuuacacacugugagcccaccgaagcugccuuccaggcacauuaccgaguuugccaggucacucacagauuuagggacgaucucaaaaagacggugacaccucagaacuucaccccagguuguuaucggacucugaauuuauuccguuacaaaagccgcugcuacauauuuaccaugugggugugucugcuaguccucgaguccauccugugggccgcuucagccagcgagguuccgcuuaaccccguguggaaugacaacgcacacggggugggcucuguaccuaugcauacagauuuggaacuggacuucucccucaccaguagcucuaaguauacuuacagaaggcggcugacaaauccacuugaggaaacgcaauccauuaaccugcacaucgagauugaggaacagaccaucggagucgaugugcaugcguugggccacugguuugacgggcgacucaaucugaagacuucauuccacugcuauggagcuuguacaaaauacgaguaucccuggcauaccgccaagugccacuacgaacgcgauuaucaguacgagacaaguugggguuguaacccugcagacugcccaggcguugggacuggaugcaccgccuguggcuuauaccuggaccagcuaaaacccguggguagcgcuuauaagauaauuacgaucagauacucgaggaaagucugcgugcaauuuggggaagagaaucucuguaagguuauugauaugaacgacugcuucgugacccggcauguaaaggucuguaucauaggcacaguguccaaauuuucucagggagauacucugcuuuucuuuggcccguuggaagggggaggucugaucuucaagcacuggugcaccagcacaugucaguuuggcgacccuggggauauuaugucaccacgcgacaaaggauuccucugccccgaguuuccuggcaguuucagaaagaaauguaauuucgccacuacgccccugugcgaguaugaugguaacaugguguccggguacaagaaagucauggcaaccaucgacucuuuucagagcuucaacacauccaccaugcauuuuacugaugaaaggauugaguggaaggacccagauggcauguuacgugaccacaucaauauacugguuacaaaggauauugacuucgacaaccuuggagaaaauccuuguaaaaucggcuugcaaaccucaagcaucgagggggcuuggggaaguggcguggguuuuacucuuaccugccugauuucucuaacagagugccccacguuccugaccuccaucaaggccugugauaaagcgauuugcuauggggccgaaagcguaacucucacacggggacagaacaccgugaaggucucgggcaaagguggccacucagggucuacauuuaaguguugccauggagaggaauguagucagauaggccugcacgcugcagccccacaucuugacaaggugaaugggaucuccgagauugaaaacaauaaaguuuacgaugacggagcuccgcaaugcggcgugaaguguugguucgucaaaagcggugaguggaucucugggauuuuuagcggaaacuggaucguguugauaguucugugcguguucuuacucuuuucccugguccuucugucaguauuguguccugugcgaaagcacaaaaagaguuga

SEQ ID NO: 10071 - RNA, 3408 nt, Artificial Sequence
  derived and/or modified CDS sequence (opt3) from HTNV(LongquanAa-11-473)__KC344263.1__GP
augggcaucuggaaguggcuggugauggccagccucgucuggcccgcuuucacccuuagaaacguuuacgacaugaaaauugagugcccucacacaguguccuuuggggaaaauucuguaauaggauauguggagcugccaccgaugcccuuggcagauacugcccagauggucccugaaucaaguuguaacauggacaaucaucaaagcaugaacacgaucaccaaguacacacagguguccuggagggguaaagcggaucaggcucaggccucucaaaauucguucgaggcaguuucagccgaaguggacuuaaagggcauuugcguccugaaacacaagaugcuagaggagagcuaucggagucgcaaguccaucacuuguuacgaucucucuugcaacagcaccuauuguaaaccaacacuguacaugauugugcccauccaugcuugcaauaugaugaaguccugucuuauagcacuggggccuuaucgaguacagguuguguacgaacguaccuacugcaugacuggagucuugcucgagggcaaauguuuugugccagaccagucaguggucaguaucauuaagcacgguaucuucgauauugccagcguucauaucgugugcuuuuucguagcugugaaagggaacacauauaagcuguuugaacaggucaagaaaucuuuccaauccaccuguaaugacacggagaacaaggugcagggauacuauauaugcauuguuggcggcaauucagcccccaucuacgugccuacucuggaugacuuuagaagcauggaggcguucagugggauuuuuaggucuccacacggagaagaucacgaccucgcuggugaggaaaucgccuccuauagcaucgucggcccggcuaacgccaaagugccccauucggcaucuuccgauaccuuaucacugauugcuuacagugggauaccuagcuauuccucucuuagcaucuuggccaauucaacagaggcgaagcacguauucaguccaggauuuuucccccagcugaaccauacuaaaugcgacaagaccgccauuccucuaaucuggacaggcaugauagaccucccagguuacuacgaagcaauucaccccuguaccguuuucugcgugcuguccgggccgggagcuagcugugaggccuuuucugagggcggcaucuucaauaucacgucaccuaugugccuugucaguaaacagaaccgguuucgccugacugaacaacagauuaacuucgugugucagagagucgauguggacaucauuguuuauugcaaugggcaaaggaaggugauauugacaaagacccucguaaucggacaguguauuuacacuaucacaagccuguuuuccuuacugcccggugucgcucacucuaucgccguggagcucugcguuccaggcuuccaugggugggcaaccgccgcacuucuggugacguuuuguuucggaugggucuugauuccugcgcuaacccugauaauccucacaauucugaaauuuaucgcaaacauuuuccacacuucgaaucaggaaaaccggcuuaagagcgugcugcgcaaaaucaaggaggaauuugagaaaaccaagggcuccaugguaugcgauguguguaaguaugagugcgaaacauacaaagaguugaaggcccaugguguuucaugcccccagagucaauguccauauugcuucacucacugugaacccaccgaggcugccuuucaggcacauuaccgagucugccaggugacacacagauucagggacgaucucaaaaagaccgugacuccucagaauuucacgccaggguguuaucggacacugaacuuauuucguuacaaaucucgcugcuacauauucaccaugugggucugucugcuaguucucgaaagcauccugugggccgcuuccgccucagaggugccgcuuaaucccguguggaacgacaaugcacacggcguaggaagcgucccuaugcauacugauuuggagcuggacuuuucucucaccuccaguagcaaguauacauacagaaggcggcugaccaacccacuugaagagacucaaucuauuaaucugcacaucgaaauugaggagcagacaaucggcguggauguucaugcguuggggcacugguucgacggacgacucaaccugaagacguccuuucacugcuauggugcuuguaccaaauacgaauaucccuggcauacugccaagugccacuacgagcgcgauuaucaguacgaaacaucauggggcuguaauccugcagacugcccaggggugggaaccggcugcacagccugugguuuauaccuggaccagcuaaaacccgucgggagugcuuauaagauaauuacuaucagauacagcaggaaagugugcguucaauucggcgaggaaaaccucuguaaggugauugauaugaaugacugcuuuguaacccggcaugucaagguguguaucauaggaacggugucgaaauucucccagggcgauacccugcucuuuuucgggccguuggagggagguggccugaucuuuaagcacuggugcacaucuacuugucaguucggggacccuggagauauuaugagcccacgcgacaaaggcuuucucugccccgaguucccugguucauucagaaagaaauguaacuuugccaccacaccccugugcgaauaugaugggaacauggucaguggcuacaagaaaguuauggcaacuaucgacuccuuccagucuuuuaauaccagcacgaugcauuucacagaugagaggauugaauggaaggacccagauggaauguuacgugaccacaucaacauacuggugaccaaggauauugacuuugacaaucuuggcgagaacccuuguaaaaucggguugcaaacuuccucaaucgaaggagcuuggggcagcgguguaggguucacacuuaccugccugauuagucuaacugagugccccaccuuucugacaucuaucaaggccugugauaaagcgauuugcuauggagccgaguccgugacgcucacccggggccagaauacugucaaggugagcgguaaaggcgggcacucgggaucaacauucaaguguugccauggcgaagaguguucucagauagggcugcacgcugcagccccacaucuugacaagguuaacggaaucagugaaauugagaauaacaaaguguacgaugacggcgcuccgcaaugcggugucaaguguugguuugugaaauccggggaauggaucagcggaauuuucucuggcaauuggaucguuuugauagugcugugcgucuuuuuacucuucagccugguacuucuguccguguuguguccuguucgaaagcacaaaaagucauga

SEQ ID NO: 10072 - RNA, 3408 nt, Artificial Sequence
  derived and/or modified CDS sequence (opt3) from HTNV(LongquanAa-11-642)__KC344262.1__GP
auggagaucuggaaguggcuggugauggccagccucgucuggcccgcuuucacccuuagaaacguuuacgacaugaaaauugaaugcccucacacaguguccuuuggcgagaauaguguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugcucgaaggaaaauguuuugugccagaccagucaguggucaguauaaucaagcacggcauuuucgauaucgccagcguucauauugugugcuuuuucguagcugugaaagguaacaccuauaagcuguuugagcaggucaagaaaucuuuccaauccacguguaaugacacugagaacaaggugcagggguacuauaucugcauaguuggaggcaauucagcccccauuuacgugccuacccuggaugacuuuagaagcauggaagcguucaguggcaucuuuaggucuccacacggggaggaucacgaccucgcaggagaagagauugccuccuauagcaucgucgguccggcuaacgccaaagugccccauucggcaucuuccgauacauuaucacugaucgcuuacaguggcauuccuagcuauuccucucuuagcauauuggccucaaguacugaagcgaagcacguauucuccccaggguuuuucccccagcugaaucauaccaaaugcgacaagacagccaucccucuaauuuggaccggaaugaucgaccucccaggcuacuacgaggcaauacaccccuguacgguuuucugcgugcugagcgguccgggggcuucuugugaggccuuuucagaaggaggcauuuucaacaucacuucuccuaugugccuugucagcaaacagaaucgguuucgccugacagagcaacaggugaacuucgucugucagagaguggauguugacaucauuguguauugcaacggccaaaggaagguaaucuugaccaagacucucgucauugggcaguguauauacacaaucaccucccuguuuucuuuacugcccggaguggcucacucgauugccguugaacucugcgugccagguuuccauggcugggcaacggccgcgcuucuggucaccuuuuguuucggguggguguugaucccugcucuaacacugaucauucucacuauacugaaauuuaucgcaaauauuuuccacaccagcaaccaggagaaucggcuuaaguccguacugcgcaaaaucaaggaagaguuugagaaaacaaagggaucaauggugugcgauguuuguaaguaugaaugcgagacuuacaaagaauugaaggcccauggcgucaguugcccccagucucaauguccauauugcuucacccacugugagcccacagaagcugccuuucaggcacauuaccgagugugccaggugacccacagauucagggacgaucucaaaaagacugucacgccucagaacuucacaccagguuguuaucggacccugaauuuauuucguuacaaaagccgcugcuacauuuucacuauguggguuugucugcuagugcucgaguccauccugugggccgcuucagccagcgaggugccgcuuaaccccguauggaaugacaacgcacacggggucggcucugugccuaugcauaccgauuuggaacuggacuuuucccucacaaguagcucuaaguauaccuacagaaggcggcugacuaauccacuugaggaaacacaauccauaaaccugcacaucgagauugaggaacagacgaucggaguugaugugcaugcguugggccacugguucgacgggcgacucaaucugaagaccucauuucacugcuauggagcuuguacuaaauacgaguaucccuggcauacagccaagugccacuacgaacgcgauuaucaguacgagaccaguugggguuguaacccugcagacugcccaggcgucgggacaggaugcacugccuguggcuuauaccuggaccagcuaaaacccguggguagcgcuuauaagauuaucaccauaagauacucgaggaaaguuugcgugcaauucggggaagagaaucucuguaagguaauugauaugaacgacugcuuugucacgcggcaugugaagguguguaucauuggcaccgucuccaaauucucucagggagauacacuguuguuuuucggcccgcuugaagggggaggucugaucuuuaagcacuggugcacuagcaccugucaguucggcgacccuggggauauaaugucaccacgcgacaaaggauuucucugccccgaguucccuggcaguuucagaaagaaauguaauuuugccacaacuccccugugcgaguaugaugguaacaugguuuccggguacaagaaagugauggcaaccaucgacucuuuccagagcuuuaacacguccacaaugcauuucaccgaugaaaggauugaguggaaggacccagauggcauguuacgugaccacaucaauauucugguaacuaaggauaucgacuuugacaaccuuggagaaaauccuuguaaaauaggcuugcaaacaucaagcauugagggggcuuggggaaguggcguggguuucacccucacuugccugaucucucuaaccgagugccccacauuucugacguccaucaaggccugugauaaagcgauuugcuauggggccgaaagcgucacccucacucggggacagaacacagugaagguuucgggcaaagguggccacucagggucuaccuucaaguguugccauggagaggaauguagucagaucggccugcacgcugcagccccacaucuugacaaggugaaugggauuuccgagauagaaaacaauaaagucuacgaugacggagcuccgcaaugcggcgugaaguguugguuuguuaaaagcggugaguggaucucugggauuuucagcggaaacuggaucguguugauuguccugugcguauuuuuacucuucucccuggugcuucugucaguuuuguguccugugcgaaagcacaaaaagaguuga

SEQ ID NO: 10073 - RNA, 3408 nt, Artificial Sequence
  derived and/or modified CDS sequence (opt3) from HTNV(LongquanAa-11-774)__KC344257.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagcccccaucuacgugccuacccuggacgauuuuagaagcauggaagcguucagugggauuuuuaggucuccacacggagaggaccacgaucuggccggugaagagaucgcauccuauagcaucgucggcccggcuaacgccaaagugccccauucggcaucuuccgacacacucucauuaauugcuuacagugggauaccuagcuauuccucucugagcauccuugccucaaguacugaagcgaagcacguauucuccccaggauuuuucccccaguugaaucauaccaaaugcgauaagacagccauuccucugaccuggacgggcaugaucgaccuaccagguuacuacgaggcaauacaccccuguacuguuuucugcgugcucagcgggccgggagcuucuugugaggccuuuucagaaggcggcauuuucaacaucacaaguccuaugugccuggucagcaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucccucuuuucucuguuacccggugucgcucacucgauugccguggaacugugcguuccaggcuuccaugggugggcaaccgccgcucuccuugugacauuuuguuucggauggguccugaucccugcguugacucuaaucauucugaccauacucaaauuuaucgcaaauauuuuccacacaagcaaccaggagaaucggcugaaguccgugcuucgcaaaaucaaggaagaguuugagaaaacuaagggcucaaugguaugcgacguguguaaguaugaaugcgagaccuacaaagaacugaaggcccaugguguuaguugcccccagucucaauguccauauugcuucacacacugugagcccaccgaagcugccuuucaggcacauuaccgagucugccaggugacucacagauucagggaugacuugaaaaagacggugacaccucagaacuucaccccaggguguuaucggacucucaaucuguuucguuacaaaagccgcugcuacauuuucaccaugugggucuguuuacugguucuagaguccauccucugggccgcuucagccagcgaggugccgcugaaccccguguggaaugauaacgcacacggcguaggaucugucccuaugcauacagaccuugaauuggauuuuucccugaccaguagcucuaaguauacuuacagaaggcggcucacaaauccacuggaggaaacgcaauccauaaaccuucacaucgagauugaggaacagaccaucggcguggacguucaugcgcuggggcacugguucgauggacgauugaaucucaagacuucauuucacugcuauggugcuuguacaaaauacgaguaucccuggcauaccgccaagugccacuacgaacgcgacuaucaguacgagacaaguuggggcuguaacccugcagauugcccaggggugggaacuggcugcaccgccuguggucuguacuuagaccagcugaaacccgucgggagcgcuuauaagauuaucacgauaagauacucgaggaaagugugcguucaauucggcgaagagaaucuauguaaggugauugacaugaacgauugcuuuguaacccggcaugucaagguguguaucauuggaacaguguccaaauucucucagggcgacacucuccuguuuuucgggccgcuugagggagguggcuugaucuuuaagcacuggugcaccagcacaugucaguucggggauccuggagacauaaugucaccacgcgauaaaggcuuucugugccccgaguucccugguaguuucagaaagaaauguaauuuugccacuacgccccucugcgaguaugacgggaacauggucuccggcuacaagaaaguuauggcaaccaucgauucuuuccagagcuuuaacacauccaccaugcauuucacugacgaaaggauugaguggaaggauccagacggaaugcugcgugaucacaucaauauuuuagugacaaaggacaucgauuuugacaaccugggcgaaaauccuuguaaaauagggcuucaaaccucaagcauugagggagcuuggggcagugguguaggguucacuuugaccugccucaucucucugacagagugccccacguuucuaaccuccaucaaggccugugacaaagcgauuugcuauggagccgaaagcgugacucugacacggggccagaacaccgucaaggugucggguaaaggcgggcacucaggaucuacauucaaguguugccauggcgagaaguguagucagaucgggcuccacgcugcagccccacaucuggauaaaguuaauggaauuuccgaaauagagaacaauaagguguacgacgauggcgcuccgcaaugcggugucaaauguugguuuguuaagagcggggaauggaucucuggaauuuucagcggcaacuggaucgugcuuauuguguugugcgucuuucuguuauucucccucguacugcuuucagugcuguguccuguucgaaaacacaagaagaguuga

SEQ ID NO: 10074 - RNA, 3408 nt, Artificial Sequence
  derived and/or modified CDS sequence (opt3) from HTNV(LongquanMf-09-8)__JQ912875.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagcccccaucuacgugccuacccuggacgauuuuagaagcauggaagcguucagugggauuuuuaggucuccacacggagaggaccacgaucuggccggugaagagaucgcauccuauagcaucgucggcccggcuaacgccaaagugccccauucggcaucuuccgacacacucucauuaauugcuuacagugggauaccuagcuauuccucucugagcauccuugccucaaguacugaagcgaagcacguauucuccccaggauuuuucccccaguugaaucauaccaaaugcgauaagacagccauuccucugaccuggacgggcaugaucgaccuaccagguuacuacgaggcaauacaccccuguacuguuuucugcgugcucagcgggccgggagcuucuugugaggccuuuucagaaggcggcauuuucaacaucacaaguccuaugugccuggucagcaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucccucuuuucucuguuacccggugucgcucacucgauugccguggaacugugcguuccaggcuuccaugggugggcaaccgccgcucuccuugugacauuuuguuucggauggguccugaucccugcguugacucuaaucauucugaccauacucaaauuuaucgcaaauauuuuccacacaagcaaccaggagaaucggcugaaguccgugcuucgcaaaaucaaggaagaguuugagaaaacuaagggcucaaugguaugcgacguguguaaguaugaaugcgagaccuacaaagaacugaaggcccaugguguuaguugcccccagucucaauguccauauugcuucacacacugugagcccaccgaagcugccuuucaggcacauuaccgagucugccaggugacucacagauucagggaugacuugaaaaagacggugacaccucagaacuucaccccaggguguuaucggacucucaaucuguuucguuacaaaagccgcugcuacauuuucaccaugugggucuguuuacugguucuagaguccauccucugggccgcuucagccagcgaggugccgcugaaccccguguggaaugauaacgcacacggcguaggaucugucccuaugcauacagaccuugaauuggauuuuucccugaccaguagcucuaaguauacuuacagaaggcggcucacaaauccacuggaggaaacgcaauccauaaaccuucacaucgagauugaggaacagaccaucggcguggacguucaugcgcuggggcacugguucgauggacgauugaaucucaagacuucauuucacugcuauggugcuuguacaaaauacgaguaucccuggcauaccgccaagugccacuacgaacgcgacuaucaguacgagacaaguuggggcuguaacccugcagauugcccaggggugggaacuggcugcaccgccuguggucuguacuuagaccagcugaaacccgucgggagcgcuuauaagauuaucacgauaagauacucgaggaaagugugcguucaauucggcgaagagaaucuauguaaggugauugacaugaacgauugcuuuguaacccggcaugucaagguguguaucauuggaacaguguccaaauucucucagggcgacacucuccuguuuuucgggccgcuugagggagguggcuugaucuuuaagcacuggugcaccagcacaugucaguucggggauccuggagacauaaugucaccacgcgauaaaggcuuucugugccccgaguucccugguaguuucagaaagaaauguaauuuugccacuacgccccucugcgaguaugacgggaacauggucuccggcuacaagaaaguuauggcaaccaucgauucuuuccagagcuuuaacacauccaccaugcauuucacugacgaaaggauugaguggaaggauccagacggaaugcugcgugaucacaucaauauuuuagugaacaaggacaucgauuuugacaaucugggcgaaaacccuuguaaaauagggcuucaaacaucaagcauugagggagcuuggggcagugguguaggguucaccuugacuugccucaucucucugaccgagugccccacauuucuaacguccaucaaggccugugacaaagcgauuugcuauggagccgaaagcgugacccugacucggggccagaauacagucaaggugucggguaaaggcgggcacucaggaucuaccuucaaguguugccauggcgaggaauguagucagaucgggcuccacgcugcagccccacaucuggauaagguuaacggaauuuccgagauagaaaauaacaaaguguacgacgauggcgcuccgcaaugcggugucaaguguugguuugugaaaagcggggaguggaucucuggaauuuucagcggcaauuggaucguucuuauuguguugugcgucuuucuguuauucucccucguacugcuuucagugcuguguccuguucgaaagcacaaaaagaguuga

SEQ ID NO: 10075 - RNA, 3408 nt, Artificial Sequence
  derived and/or modified CDS sequence (opt3) from HTNV(ROKA14-11)__KU207203.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaaaagcuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaaguuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgaccugccaggguauuacgaggccauacaccccuguacagucuucugcgugcuuucuggaccgggcgcaucaugugaggcuuucagugaaggcgggauuuuuaacaucaccagcccuaugugccuggucuccaaacagaaucgguuccgcuugacggagcaacaggugaacuuuguuugucaaagaguggauguagacaucgucguguacugcaacggacagaggaagguuauucucaccaagacacuggugaucggucaguguauuuauacuauaaccucuuuauucucgcugcuccccggcgucgcccacagcaucgcgguggaacuuugcguaccaggguuucauggaugggccacagcagcucuguuggugacuuucuguuuuggcuggguucuaauuccugccaucaccuucaucauucugacaauacucaaauuuaucgcuaauauuuuccacaccuccaaccaagagaaucggcugaagucaguccuucgcaaaaucaaggaagaguuugagaaaacuaaggguaguauggugugcgauguguguaaguacgaaugcgagacguauaaagaacugaaggcccauggggucucuugcccccagagccaguguccauacugcuucacacacugugagcccaccgaagcagccuuucaggcucauuauaaaguuugccaagugacucaccgauucagagacgauuugaagaaaaccgugacaccucagaacuucaccccaggcuguuacaggacucucaaucuguuucgguauaagucccguugcuacauuuucacaauguggaucuuuuuacugguacuagagucaauacucugggcggcaagcgccucugagacgccgcugacccccgucuggaacgacaaugcucacggagugggcuccguuccuaugcauacugaucuugaauuggacuucagucugacaucuucuuccaaguacaccuaucgcagaaaacucacaaacccacuggaggaagcccagucaaucgaucuucacauugagaucgaggaacagacuauugggguggacguccaugcacugggacacugguuugaugguagguugaaucucaagaccaguuuccacuguuacggcgccugcacgaaauaugaguaccccuggcauaccgcuaagugucacuaugaacgggacuaccaauaugagacaagcugggggugcaacccuucggacuguccaggagugggcacugguugcaccgccugcgggcuguacuuagaucgacugaaacccguuggcuccgcauacaagaucauaacaauucgcuauucuagaaggguguguguacaguuuggagaagagaaucuaugcaagaucauugacaugaacgauuguuucgucagccggcaugugaaagugugcaucauaggcacugucucaaaguuuagucagggggacacccuccuguucuuuggaccgcuugaggguggcggguugaucuucaaacacugguguacguccacaugccaguuuggagauccuggcgacauuaugucuccacgcgauaaggguuuccugugucccgaguucccugggagcuuuagaaagaagugcaauuucgcgaccacucccaucugugaauacgacggcaacaugguuuccggauauaaaaaggugauggcuacaauugauucauuucagagcuucaauaccaguacuaugcauuuuaccgacgaaaggaucgaguggaaggauccagacggcaugcuccgugaucacauaaacauucugguaacaaaagacaucgacuucgauaacuuaggggaaaauccuugcaagaucggacugcagacgucuuccauugagggcgccugggguagcggggugggauuuaccucgacuugucuugucucauugacagagugccccaccuuccucacaucuaucaaagcaugcgacaaggccauuuguuacggcgcugaaagugugacucugacccggggucagaacacgguuaaaguguccggcaaagggggacacagcggcucuacauuuaagugcugucauggggaggauugcagccagauaggacuacacgccgcagcuccacaucuggacaaggucaauggcaucuccgaaauggagaacucaaagguguaugaugacggugccccgcaaugugggauuaaaugcugguucguuaagaguggagaauggaucagcggcauuuuuagcgguaauuggaucgugcucauaguccuguguguauuccuuuuguucucccugguguuacucucaauccugugcccuguucgaaaacacaagaagaguuga

SEQ ID NO: 10076 - RNA, 3408 nt, Artificial Sequence
  derived and/or modified CDS sequence (opt3) from HTNV(US8A15-1)__KU207205.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaagaguuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaucuuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgaccugccaggguauuacgaggccauacaccccuguacagucuucugcgugcuuucuggaccgggcgcaucaugugaggcuuucagugaaggcgggauuuuuaacaucaccagcccuaugugccuggucuccaaacagaaucgguuccgcuugacggagcaacaggugaacuuuguuugucaaagaguggauguagacaucgucguguacugcaacggacagaggaagguuauucucaccaagacacuggugaucggucaguguauuuauacuauaaccucuuuauucucgcugcuccccggcgucgcccacagcaucgcgguggaacuuugcguaccaggguuucauggaugggccacagcagcucuguuggugacuuucuguuuuggcuggguucuaauuccugccaucaccuucaucauucugacaauacucaaauuuaucgcuaauauuuuccacaccuccaaccaagagaaucggcugaagucaguccuucgcaaaaucaaggaagaguuugagaaaacuaaggguaguauggugugcgauguguguaaguacgaaugcgagacguauaaagaacugaaggcccauggggucucuugcccccagagccaguguccauacugcuucacacacugugagcccaccgaagcagccuuucaggcucauuauaaaguuugccaagugacucaccgauucagagacgauuugaagaaaaccgugacaccucagaacuucaccccaggcuguuacaggacucucaaucuguuucgguauaagucccguugcuacauuuucacaauguggaucuuuuuacugguacuagagucaauacucugggcggcaagcgccucugagacgccgcugacccccgucuggaacgacaaugcucacggagugggcuccguuccuaugcauacugaucuugaauuggacuucagucugacaagcagcuccaaguacaccuaucgcagaaaacucacaaacccacuggaggaagcccagucaaucgaucuucacauugagaucgaggaacagacuauugggguggacguccaugcacugggacacugguuugaugguagguugaaucucaagaccaguuuccacuguuacggcgccugcacgaaauaugaguaccccuggcauaccgcuaagugucacuaugaacgggacuaccaauaugagacaagcugggggugcaacccuucggacuguccaggagugggcacugguugcaccgccugcgggcuguacuuagaucgacugaaacccguuggcuccgcauacaagaucauaacaauucgcuauucuagaaggguguguguacaguuuggagaagagaaucuaugcaagaucauugacaugaacgauuguuucgucagccggcaugugaaagugugcaucauaggcacugucucaaaguuuagucagggggacacccuccuguucuuuggaccgcuugaggguggcggguugaucuucaaacacugguguacguccacaugccaguuuggagauccuggcgacauuaugucuccacgcgauaaggguuuccugugucccgaguucccugggagcuuuagaaaacauugcaauuucgcgaccacucccaucugugaauacgacggcaacaugguuuccggauauaagaaagugauggcuacaauugauucauuucagagcuucaauaccaguacuaugcacuuuaccgacgaaaggaucgaguggaaggauccagacggcaugcuccgugaucacauaaacauucugguaacaaaggacaucgacuucgauaacuuaggggaaaauccuugcaaaaucggacugcagacgucuuccauugagggcgccugggguagcggggugggauuuacccuuacuuguuuggucucgcucacagagugccccaccuuccugacaucaaucaaggcaugcgacaaagccauuuguuacggcgcugaaucugugacucuaacccggggucagaacacgguuaaggugaguggcaaagggggacauuccggcagcacauuuaagugcugucacggggaggauugcucucagauaggacugcaugccgcagcuccacaccucgacaaggucaauggcaucagcgaaauggagaacuccaaaguguaugaugacggugccccgcaaugugggauuaagugcugguucguuaaaucaggagaauggaucaguggcauuuuuagcgguaauuggaucgugcugaccguccuuuguguauucuugcuguucucuuuagugcuccuguccauacuuugcccuguucgaaagcauaaaaagucauga

SEQ ID NO: 10077 - RNA, 3408 nt, Artificial Sequence
  derived and/or modified CDS sequence (opt3) from HTNV(Lee)__D00377.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaacuagcuuugagaccguguccacagaagucgaccucaaggggaccugcgugcugaaacacaagaugguagaggagucuuaucggagccgcaaguccauuacuuguuacgaucuuucaugcaacaguacauauuguaaaccaacccuguacaugaucguucccauucaugcgugcaauaugaugaaaagcuguuugaucgcucucgggccuuaucgagugcaggucguguacgaacguacguacugcaugacuggagugcugauagagggcaaauguuucgucccagaccagucuguuguguccaucauuaagcacgguaucuuugauauugccucaguacauaucgugugcuucuuugucgcagugaaagggaacaccuauaagauauucgaacagguuaagaaaaguuuugagaguacauguaaugacacugagaacaaggugcaaggauacuauauuugcaucgucggcggcaauucugcccccauuuacgugccuacccuggaugacuucagauccauggaagcauuuacagggaucuucaggagcccacacggagaggaucacgaccucgcuggugaagagaccgccacguauucgaucguaggcccggcuaacgccaaaguuccccauucugcguccucagauacuuuaagucugauugcauuuagcgggauaccuuccgacucuagccuuucaaucuugacaaguuccaccgaagccaagcacguguucagcccaggacuguuucccaaacuaaaucauacuaacugcgacaagggcgcuauuccucucauguggacagguaugaucgaucugccaggguacuaugaggccauacaccccuguaccgucuucugcgugcuuucuggaccgggcgcaucaugugaggcuuucagugaaggcgggauuuuuaauaucacguacccuaugugccuggucagcaaacagaaccgguuccgcuugaccgagcaacaggugaauuuuguuugucagagaguggacguagauaucgucguguacugcaacggacagaggaagguuauucucacaaagacucuggugaucggucaguguauuuauaccauaacauccuuauucucucugcuccccggcgucgcccacucgaucgcgguggaacuuugcguaccaggguuucauggaugggccacugcagcucuguuggugaccuucuguuuuggcuggguucuaauuccugccaucacauucaucauucugaccauacucaaauuuaucgcuaacauuuuccacacuagcaaucaagagaaccggcugaaguccguccuucgcaaaaucaaggaagaguuugagaaaacgaaggguucaauggugugcgacguguguaaguacgaaugcgagacauauaaagaacugaaggcccauggggucaguugcccccagucucaguguccauacugcuucacccacugugagcccacugaagcagccuuucaggcucauuauaaaguuugccaagugacccaccgauucagagaugacuugaagaaaacagugaccccucagaauuucacuccaggcuguuacaggacacucaaccuguuucgguauaagagccguugcuacauuuucacgauguggaucuuuuuacugguacuagaguccauacucugggcggcaucagccagcgagaccccgcugacucccgucuggaaugauaacgcucacggagugggcucuguuccuaugcauacagaccuugaauuggauuucucccugaccaguagcucuaaguacacauaucgcagaaaacucacuaauccacuggaggaagcccaguccaucgaccuucacauugagaucgaggaacagaccauugggguggauguccaugcacugggacacugguuugacgguagguugaaccucaagacgucauuccacuguuacggcgccugcaccaaauaugaguaccccuggcauacagcuaagugucacuaugaacgggacuaccaauaugagaccaguugggggugcaauccuagcgauuguccaggagugggcacugguugcacagccugcgggcuguacuuagaccgacugaaacccguuggcucggcauacaagaucauaacuauucgcuauuccagaaggguguguguacaguuuggagaagagaaccuaugcaagaucauugauaugaaugacuguuucgucucucggcaugugaaagugugcaucauaggcaccgucagcaaguuuucacagggggauacgcuccuguucuuuggaccgcuugaggguggcggguugaucuucaaacacugguguacaaguaccugccaguuuggagacccuggcgauauuauguccccacgcgacaaggguuuccugugucccgaguucccugggucuuuuagaaagaagugcaacuucgcgacuacacccaucugugaauacgauggcaauaugguuagcggauauaaaaaggugauggcuaccauugacuccuuucaaucauucaacacuagcaccaugcauuuuacagaugaaaggaucgaguggaaggacccagauggcaugcuccgugaccacauaaauauucugguaacgaaagacaucgauuucgacaacuuaggggaaaacccuugcaagaucggacugcagaccaguucuauugagggcgccugggguuccggggugggauuuacucuuacauguuuggucagccucaccgagugccccacauuccugacuucgaucaaagcaugcgauaaggccauuuguuacggcgcugaaucagugacccuaacgcggggucagaauacaguuaaagugucuggcaagggcggacacaguggcuccaccuuuaagugcugucauggggaggacugcagccagauaggacugcacgccgcagcuccacaucucgauaaagucaacggcaucucugaaauggagaauagcaaggaauaugacgauggugccccgcaaugugggauuaaaugcugguucgugaaguccggagaguggaucucaggcauuuuuagugguaacuggaucguucugauagugcuuugugucuucuugcuguucagcuuaguacuccugucuauccuuugcccugugcgaaaacacaagaaguccuga

SEQ ID NO: 10078 - RNA, 3384 nt, Artificial Sequence
  derived and/or modified CDS sequence (opt3) from HTNV(M)__U38177.1__GP
auggccagccugguguggcccguccucacccuuagaaacguuuacgacaugaagaucgagugcccucacacaguguccuucggcgaaaauucuguaauuggguauguggagcugccaccgguccccuuggcugauacugcacagauggugccugaaucaaguuguaacauggacaaucaucagagcuuaaacacgauaaccaaauacacacagguuuccuggaggggaaaggccgaucagucucagucgucacaaaauagcuuugagacugugaguaccgaagucgaccugaaagguacaugcgugcuaaagcacaaaaugguagaggaguccuaucggucucgcaagagcguuaccuguuacgaucucuccugcaacucaacuuauuguaagccaacacuguacaugaucgugcccauucaugcgugcaauaugaugaaaaguugucuuaucgcucugggcccuuaucgaguccaggugguguacgaacguagcuacugcaugaccggggucuugauugagggaaaguguuucguuccagaccagucugugguauccaucauaaaacacggcaucuuugauauugccucagugcauaucgucugcuucuuuguggcaguuaaggguaacacguauaaaauuuucgaacaggugaaaaagagcuuugagaguacuuguaaugacaccgagaacaagguccaaggguacuauaucugcauagugggaggcaauucugcccccauuuacguaccuacacucgaugacuucagauccauggaggcuuuuacuggcaucuucaggagcccacacggggaggaucacgaccuggcaggagaagagauugccucguauucuaucguuggugcugccaacgcgaaggugccgcauuccgcaucaagugauacccugcggcucaucgccuacagcggcauucccuccuauucuagcuuaucaauacugacaaguuccaccgaagcuaaacacgucuuuagcccugggcuuuucccaaaguugaaucauacgaacugcgacaaaucugccaucccccugauuuggacuggaaugaucgaccuaccuggcuacuacgaggcagugcacccauguacagucuuuugcgugcucucaggucccggggcuaguugugaggccuucagcgaaggaggcauauucaauauuaccuccccgaugugccugguuucuaagcagaaccgcuuuagacuuacugagcaacaggugaacuucguaugucaaagggucgauauggacaucgugguuuauugcaauggccagcggaaagugauccugacaaagaccuuggucauugggcaguguaucuacacgauuaccucgcucuuuagccuguuaccuggaguggcgcacuccauagccguagaacugugcgugcccgguuuccauggcugggcaacagcugcccuccuuguuacuuuuuguuucggguggguccugaucccagcuauuaccuuuaucaucuugacagugcuaaaguucauugccaacauauuucacacuucaaaucaagagaaccgccugaaaagugugcuccgaaagaucaaagaagaguucgagaagaccaaaggaucuauggucugcgauguuuguaaguaugaaugcgagacauacaaggaacugaaagcacauggcgugagcugcccucagucccagugucccuauugcuuuacccacugugagccaacugaagccgcuuuccaggcgcauuacaaggugugccaaguaacgcacagauuuagggacgaucuuaaaaagacagucacuccccagaauuucaccccugguuguuaucggacccugaacuuguuccguuacaaaucacgcugcuacauuuuuacaauguggaucuuccuccugguguuagagagcauucugugggcagccucugcuuccgagaccccacuaacuccgguuuggaaugacaacgcccacggggugggcaguguccccaugcauacagaucucgaacuggacuuuagccuuacgucuuccucaaaguauaccuacagaaggaaguugacuaauccucuggaggaagcacagaguaucgaucuccacauagagaucgaggaacagacaauuggaguggacguucaugcccugggccacugguucgaugggcggcuuaaccugaaaaccagcuuucacuguuauggagcuugcacaaaguacgaguauccauggcauacugccaaaugucacuacgaacgagacuaucaauacgagaccucgugggguugcaaucccuccgacuguccuggcguggggacgggaugcaccgcaugcggcuuguaccucgaucagcugaagccaguagguucugcguauaaaaucauuacaauccgcuacagcagaagggucugugugcaguucggggaagagaacuuaugcaagauaauugacaugaaugauuguuuugugucacggcaugucaagguuugcaucauuggcacugugaguaaauucucccagggagacacccugcuauuuuucggcccccucgaagggggaggucugaucuuuaagcacugguguacaucuacuugccaauucggcgauccgggggacauaaugagcccucgcgauaaaggauuucuuuguccagaguuccccggcuccuucagaaagaaaugcaacuuugcuaccacgccuaucugugaguaugacgguaauaugguaucaggguacaagaaagugauggccacaauugauagcuuccagaguuuuaacaccucuacuaugcauuucacagacgaaaggaucgaguggaaggaucccgacggcauguugcgugaucacauuaacauccuggucaccaaggacauagacuuugauaaucucggagaaaacccaugcaaaauuggccugcagacuuccagcaucgagggggcauggggaucgggcguggguuucaccuuaacaugucugguuucacuuacggagugcccuaccuuuuugacuucuaucaaggccugcgacaaagcuauuuguuauggggccgaaagugugacacucacccggggacagaauacagucaagguguccggcaaagguggccacagcgggucuacuuucaagugcugucauggagaggauugcagccaaaucggccugcacgcagcugcgccccaucuagacaagguuaacgggauuuccgaaauagaaaauucaaaaguguacgaugacggagccccacaguguggcaucaagugcugguuugucaaaaguggugaauggauuagcgggaucuucucuggaaacuggauuguacugaucgugcucuguguuuuucugcuuuucuccuuggugcuguuaucaauacucugcccgguccgaaagcacaaaaagaguuga

SEQ ID NO: 10079 - RNA, 3408 nt, Artificial Sequence
  derived and/or modified CDS sequence (opt3) from HTNV(N8)__EF077656.1__GP
augggcaucuggaaguggcuggugauggccagccucgucuggcccgcuuacacccuuagaaacguuuaugacaugaaaauugagugcccucacacaguguccuucggggaaaauucuguaauaggauacguggagcugccaccgaugcccuuggcagauacugcccagauggucccugaaucaaguuguaacauggacaaucaucaaagcaugaacacgaucaccaaguauacacagguguccuggagggguaaagcggaucaggcucaggccucucaaaauucguuugaggcaguuucagccgaaguggacuuaaagggcacuugcguccugaaacacaagaugcuagaggagagcuaccggagucgcaaguccauuaccuguuaugaucucucuugcaacaauacauacuguaaaccaacccuguauaugaucgugcccauucaugcuugcaacaugaugaaaagcugucuuaucgcacuggggccuuaccgaguacagguuauauacgaacguacuuauugcaugacaggaguguugaucgagggcaaguguuucgucccagaccaguccguggugucaauuaucaagcacgguauuuuugauaucgccaguguccauauaguuugcuucuuuguggcuguaaaagggaauaccuacaaacucuucgaacaggugaagaagucuuuucaaucuacguguaacgacacugagaauaagguccagggauauuacauuugcaucgugggcggcaacuccgcccccauuuauguuccuacccuggaugacuucagaucaauggaggcguuuagcgggaucuucaggaguccacacggagaagaucacgaccuggcaggggaggaaaucgccucuuacuccauugugggcccggcuaaugccaaagucccccauagcgcaucgucugauacacucuccuuaauagcuuauucagggaucccuaguuacagcucccugucuauucuuacuggaagcaccgaggccaagcacguguuuucaccaggcuucuuuccccaguugaaccauacaaaaugcgacaagaccgcgaucccucugacguggacugguaugauagaccuaccaggguacuaugaagccauucaccccuguacaguauucugcguucucaguggaccgggcgcauccugugaggcuuucagcgagggcgggaucuuuaauaucaccucuccuaugugccuggugucaaaacagaaccgguuccgccuuacugaacaacaggucaacuuugugugucagagagucgauauggacauuaucguguacugcaauggacaaaggaagguuauucugacaaagaccuuggugauaggucaguguaucuauacgauuaccagucucuucagccuguuacccggcguagcccacuccaucgcugucgagcugugcgugccaggguuucauggaugggccacagcagcccuccuuguuacuuucuguuuuggcugggugcugaucccugcuauuaccuucauaaucuugacaguccuaaaauuuauugcgaacaucuuccacacuucuaaucaggaaaaccggcugcgcgcagugcuccgaaagauuaaagaggaauuugagaagaccaaagguucgaugguaugcgauguguguaaguacgagugcgaaacauauaaggagcugaaagcccaugggguuagcugcccccagucccaauguccauacugcuucacccacugugaacccacugaggcugccuuucaggcacauuauagagucugccaggugacgcacagguuccgggacgaucuuaagaaaacagugaccccucagaauuucacuccaggcuguuaccguacccugaacuuguuucgcuacaagucaagaugcuauaucuucacaaugugggucugucuccugguuuuagaaaguauacugugggccgcuucugccagcgaggugccgcuaaaucccguguggaacgacaaugcacacggaguaggcuccgucccuaugcauaccgaucucgagcuggacuuuucacuuacuagcagcuccaaauacacauauaggcggcgauugacgaacccacuggaagagacccaagcgaucaaucuccacauugaaaucgaggagcagacuauugggguggauguucaugcucugggacacugguucgacggucgccuuaaccugaagacaaguuuucacugcuacggcgccuguaccaaguaugaauaccccuggcauacagcaaaaugccacuaugagagagauuaccaguacgaaacuagcuggggguguaauccugccgacugcccaggagugggcaccgguugcacggcuuguggguuguauaucgaccagcucaagcccgucggcucugccuacaaaauaauuaccaucagguauucccggaaggugugcguucaauucggagaggaaaaccuguguaaagugauugauaugaaugacugcuuuguaucacgccaugucaagguguguaucauaggcacagugaguaaguucagccagggggauacuuuacuguuuuucggaccgcuagaggguggcgggcucaucuuuaaacacuggugcaccucgacaugucaguucggagacccuggcgauauuauguccccaagagacaaggguuuucugugccccgaguucccugggucuuucaggaaaaaguguaacuuugcaacuacgccccuuugcgaauacgauggcaacauggucagcggauauaaaaagguuauggcuaccaucgacucauuccagaguuuuaauacauccaccaugcauuucacugaugagcguauugaauggaaagacccagauggcauguugcgggaccacaucaacauacuggugacaaaggauauugacuuugacaaucucggggagaacccuuguaagaucggacugcaaaccucuagcaucgaaggcgccugggguuccgggguaggauucacuuuaaccugccuggugucacuuacagagugccccacguuuuugaccagcauuaaagcgugugauaaggccaucugcuacggcgcugagagugucgcacucacucgaggucagaauacagugaaaguuucuggcaaggguggacacuccggcagcaccuucaaauguugccauggggaagaguguucgcagauuggacugcacgccgcugccccacaucuagacaaggugaacggcauaucagaagucgagaauaacaagguguaugaugacggugcaccgcaaugcgggguuaaauguugguuugugaagucuggagaauggaucaguggcauuuucuccgguaauuggaucguccugauuguacucugcguguuucugcuuuucagcuugguucuguuaucugugcucuguccugucagaaaacacaagaaaagcuga

SEQ ID NO: 10080 - RNA, 3408 nt, Artificial Sequence
  derived and/or modified CDS sequence (opt3) from HTNV(Q32)__DQ371905.1__GP
augggcaucuggaaguggcuggugauggccagccucgucuggcccgcuuucgcacuuagaaacguuuacgacaugaaaauugagugcccucacaccguguccuuuggggaaaauucuguaauaggauauguggagcugccaccgaugcccuuggccgauacaacucagauggucccugaaucaaguuguagcauggacaaccaucaauccuuaaauacgaucaccaaguacacacagauuaucuggagggguaaagcggaucagucucagucgucacaaaacagcuucgagacugugaguaccgaaguugaccugaagggcacaugcgugcuaaaacacaagaugauugaggaguccuaucggucucgcaagagcaucaccuguuacgaucucuccugcaauucaacuuauuguaaaccaacacuguacaugauaguccccauccaugcuugcaacaugaugaagaguugucuuauugcccuggggccuuaucgagugcagguaguuuacgaacguaccuacugcaugacgggaguguugaucgagggcaaauguuuugucccagaccagagcguggugucuauuaucaagcacgguauauucgauauugcauccguccauaucguuugcuuuuucguggccguaaaagggaauacuuauaagauuuuugaacaggugaagaaaucauucgagagcaacuguaaugacaccgagaacaagguccaaggauacuauaucugcaucauuggcggcaauaguucucccguguacguuccuacacucgaugacuuuagauccauggaagcauucagcgggauauuuaggucgccacacggagaggaucacgaccuggcuggugaagagguggccucuuauuccaucgucggcccggcuaacgccaaagugccccauucagcgaguagcgauacucuggggcucauugcauacuucggaaucccuuccuauucuagcuuaucaauacugaccaguuccacagaagccaagcacguauuuagcccaggccuuuucccccaguugaaucauaccaaaugcgacaagacggcuauuccucugacuuggacagguaugaucgaccuaccaggguacuacgaggccauccaccccuguaccguuuucugcgugcucucuggaccgggcgcaucaugugaggcuuuuagugaaggcgggauuuucaacaucacuagcccuaugugccuggucuccaaacagaaucgguuucgccuuacagagcagcaagugaacuucgucugucagagaguggauguugacauuauaguguauugcaacggacagaggaagguaauccugaccaagacguuggucauuggucaauguaucuacaccaucacaucucucuuuucgcuguuacccggcguggcccacagcauugcgguugaacugugcgugccaggguuccauggaugggccacugcagcucuccuugucaccuuuuguuucggcugggugcugauaccugccaucacauuuauuaucuugacuauucuaaaauucaucgcuaauauauuucacaccuccaaccaggagaaucggcugaagucaguacuccgcaaaaucaaggaagaguucgagcgaacaaaagguaguauggugugcgauauuuguaaguaugaaugcgagaccuacaaggaacugaaagcccaugggguuucuugcccccagagccaguguccauauugcuuuacucacugugagcccacggaagcagccuuccaagcucauuacaaggucugccaggugacacacagauucagggacgaucuuaaaaagaccgugacuccucagaacuuuaccccaggcuguuaucggacacugaauuuguuccguuacaaaucccgcugcuacaucuuuaccaugugggucuuccuccugguuuuagagucaauucugugggcggcaagcgccucugagaucccgcuaaaccccguguggaaugacaacgcucacggagugggcuccauaccuaugcauacugaucucgaacuggacuuuagucuuacaucuagcuccaaguauacguacagaaggaaguugaccaauccacuggaggaaucacaggccauugaucuccacguagagaucgaggaacaaacuauuggggucgacgugcaugcacugggacacugguucgauggucggcuuaaccugaaaacaaguuuucacuguuauggcgccugcaccaaguacgaguaucccuggcauacagcuaaaugucacuacgaacgagacuaucaguacgagacuagcugggggugcaauccuucggacuguccaggaguuggcaccgguugcacggccugcggguuguaccucgaucagcugaagcccgugggcuccgcauauaaaaucauaaccauccgcuacucuagaagggucugugugcaguucggagaagagaacuuaugcaagauuaucgacaugaaugauuguuuuguuagccggcaugugaagguaugcauuaucggcacagucucaaaauucagucaaggggacacucugcuauuuuucggaccgcucgaggguggcgggcugauauuuaagcacugguguaccuccacaugccaguucggagauccuggcgacauuaugucuccacgcgauaaagguuuccuuugucccgaauuuccugggagcuucagaaagaaaugcaacuuugcgacuacccccgugugugaguaugacggcaauaugguguccggauacaagaaagucauggcuacgaucgauucauuccagagcuuuaacacaaguaccaugcauuucacugacgaaaggaucgaguggaaggauccagacggcauguugcgugaucacauuaacauccugguuacaaaggacauugacuuugauaaucucggggaaaacccuugcaaaauaggacugcagaccucuuccaucgagggcgccugggguagcggggugggauucacuuuaaccugucugauuucgcuuacagagugcucaacguuuuugaccucuaucaaggcaugcgacaaagccauuuguuauggcgcugaaaguguaacucucauccggggucaaaauacagugaaggucuccggcaaagggggacacagcggcucuagcuucaagugcugucauggggaggaaugcucccagauaggacugcacgccgcagcuccccaucuagauaaggugaacggcaucucagagauggaaaauaguaaaguuuuugacgauggugccccacagugugggauuaagugcugguucgugaaaagcggagaguggaucucuggcauuuucuccgguaacuggaucguccugauagugcucuguguuuuucugcuuuucucauuggugcuguuaaguauucucugcccgguccgaaagcacaaaaagagcuga

SEQ ID NO: 10081 - RNA, 3408 nt, Artificial Sequence
  derived and/or modified CDS sequence (opt3) from HTNV(Bao14)__AB127995.1__GP
augggcauguggaaguggcuggugaucgccagccucgucuggcccgcucuugcacugagaaacguuuacgacaugaaaauugagugcccucacaccguguccuucggggaaaauucuguaauaggauauguggaguugccaccgaugcccuuagccgauacagcgcagauggucccugaaucaaguuguagcauggacaaccaucaauccaucaauacuauuacgaaguacacccaggugaucuggagggguaaagcugauccaggccagucuucgcagaacucauuugagacaguuagcacugaaguggaccugaaggggaccugcguccuaaaacacaagaugguggaggagaguuaucggucccgcaagucuauuacauguuacgaucucagcugcaauuccaccuauuguaaacccacucuguacaugaucguaccuauacaugccugcaacaugaugaagucaugucuuaucgcacugggaccauaucgaguucaaguggucuacgaacguacauacugcaugaccggcguguugauugaggguaaauguuucgugcccgaccagagugucguuagcaucauuaagcacgggaucuuugauauagccucugugcauauuguaugcuucuuuguggcugucaaaggaaauacguauaaguuguucgaacaggugaagaaauccuuugagucaacuuguaacgacaccgagaauaagguucagggcuacuauaucugcauugugggcgggaacagcgcaccuaucuacgucccaacacuggaugacuucagaaguauggaagccuuuacuggaaucuucaaaucuccgcacggugaggaucacgaccuggcuggcgaagagauugccuccuauagcauaguggggcccgcgaaugcaaagguaccucauucggccucuuccgauacccucucauuaaucgcuuacagugggauuccaagcuauuccucucugagcauccuuacaucaaguaccgacgccaaacacguuuucucccccggcuuguucccuaagcugaaccauacgaauugcgacaaaagcgcaauaccacuaacuuggacagguaugauugaucuccccggguacuacgaagcuauccacccguguaccguguuuugcguccugucuggaccuggcgccucaugugaggcguucagugagggcgggaucuucaacauuacuagccccaugugccuuguguccaagcaaaauagguuucggcugacagaacagcaggucaacuucgugugucagcgcguugacauggauaucgugguauauugcaacggacaaagaaaggucauuuugaccaaaacgcucgugauaggucaguguaucuacaccauuacaucucuguuuucguuacugccaggcguugcccacagcaucgcaguggagcucugcgucccuggguuccauggaugggcuacugccgcccuucuggugaccuuuuguuucggcuggguauugauccccgcugugacauuuauuauacuaacuguucugaaguucaucgcaaauauuuuucacaccuccaaccaggaaaauaggcucaaaucaguccugcggaagaucaaagaggaauuugagaagacaaaggguaguauggugugcgacguguguaaauaugagugcgaaaccuacaaggagcuuaaagcccauggggucucuugcccacaaagccagugucccuauugcuuuacucacugugaaccuacggaggcugcguuccaggcacauuacaagguuugccaggugacacaccgcuuucgagaugaccugaaaaagaccgugacuccacaaaacuucaccccgggcuguuauagaacauugaaucucuucagguacaagucccggugcuacauuuuuaccauguggguauuccuguuaauccuggaaucaguccuaugggccgcuagcgccucugagacuccccucacaccuguguggaacgauaaugcacacggaguuggcuccgugccaaugcauacggaccuggagcuugauuuuaguuugaccaguucuuccaaauauacuuaccgucgcaagcugacaaacccccucgaagaggcccagucaauagaccugcacaucgaaauugaggagcagaccaucggggucgaugugcaugcucuuggacacugguucgacgguagacugaauuugaaaacaaguuuucacuguuauggcgccugcacuaaguacgaauauccuuggcauaccgcaaaaugucacuacgagagggacuaucaguacgaaacgagcugggggugcaacccaucggauugucccggaguuggcaccgguugcacagcgugcgggcucuaccuggaccaauuaaagccggugggcuccgcuuauaagauuaucacuauacgguacucucgacgcguauguguccaguucggagaggaaaaucugugcaaaauuaucgauaugaacgacuguuuugugagcagacaugugaaggucugcauuaucggcaccguuucaaaauucagucagggggauacacuacucuuuuucggaccucuggaggguggcgggcuuauauuuaagcacugguguacuucuaccugccaguucggagacccaggcgauaucaugucccccagggacaaagguuuucucuguccugaguuccccgggagcuuccggaagaaaugcaauuuugccacgacaccaauuugugaauaugauggcaacaugguguccggauacaagaagguaauggcaaccaucgacucauuccagagcuuuaauacuagcacaaugcauuucaccgaugagcgcauugaauggaaagacccugauggcaugcugagagaccacaucaacauacucgugacuaaggacauugauuuugacaaccugggggagaaucccugcaaaaucggauuacaaaccucuuccaucgaaggcgccugggguagcggggucggauucacacugacgugucuugugucguugaccgagugcccaacuuuucucacaucaauuaaggcuugcgauaaagccaucuguuauggcgcagagucuguuacccugacaaggggucagaacacugugcgugucaguggcaagggaggacacuccggcagcaccuucaagugcugucauggggaagacugcucuaaaauuggacuacacgcugccgcgccgcaucuggauaaggugaauggcauaagcgagaucgaaaacuccaaaguuuacgacgauggugccccucagugugggauuaagugcugguuugugaaaucaggagaguggaucaguggcauuuucagcgguaauuggaucguccucauaguacuguguguguuucuuuuguucucucugguuuuacucuccauccugugccccgugcggaagcacaagaaaucauga

SEQ ID NO: 10082 - RNA, 3408 nt, Artificial Sequence
  derived and/or modified CDS sequence (opt3) from HTNV(HubeiHu02)__JQ665881.1__GP
augggcaucuggaaguggcuggugauggccagccucgucuggcccgcuuucgcacuuagaaacguuuacgacaugaaaauugagugcccucacaccguguccuuuggggaaaauucuguaauaggauauguggagcugccaccgaugcccuuggccgauacagcgcagauggucccugaaucaaguuguagcauggacaaccaucaauccuuaaauacuaucacgaaguacacccagauuguguggagggguaaagcugaucagucucagucgucacaaaacagcuucgagacaguuaguacugaaguggaccugaagggcacaugcguccuaaaacacaagaugguggaggaguccuaucggucucgcaagagcaucacauguuacgaucucuccugcaauucaaccuauuguaaaccaacucuguacaugauuguacccauccaugccugcaacaugaugaagaguugucuuauagcacuggggccuuaucgaguucagguggucuacgaacguacauacugcaugaccggaguguugaucgagggcaaauguuuugugccagaccagagcgucguuucuauuaucaagcacgguauuuucgauaucgccuccgugcauauaguaugcuuuuucguggcugucaaagggucaacguauaagcucuuugaacaggugaagaaaaguuucgagagcaauuguaacgacacugagaauaagguucaaggacacuacauuugcaucgugggcggcaacucugcacccauuuaugucccuacccuggaugacuuuagauccauggaagccuucagcgggaucuuuaaaucgccacacggagaggaucaugaccuggcuggugaagagguggccucuuacuccaucguaggcccggcgaaugcaaagguuccccacucagccaguagcgauacacucuccuuaauugcuuauucugggauaccuagcuacucaagucuguccauccuuacuagcuugaccgaagccaaacauguguucucuccaggacuguuuccccagcuaaaccacacaaagugcgacaaaaccgcaauuccucucacguggacuggcaugaucgaccugccagguuauuacgaggcuguccaccccuguacaguguucugcguccuuucagggccgggagccaguugugaggcguucagcgaaggcggcauacugaauauuaccuccccuaugugcuuggugucuaagcagaacagguuucggcucacugagcagcaaguuaauuucgugugucagcgcguagaugucgacaucgugguuuacugcaacgggcagagaaaggugauccugacaaaaaccuuagucauuggacaauguaucuauacgauuaccucgcuguuuagccuccuucccgguguggcccauuccauagcaguagaacugugcgugccaggcuuccacgggugggcuacagccgcuuugcuaguuacuuuuuguuucggauggguccugaucccugccauuaccuuuaucauccucacaauucugaaguucauagcaaacaucuuucauacuucaaaucaggagaacaggcuuaaaagugugcugcggaagauuaaagaagaguucgagcgcaccaagggcucuauggugugcgaugucuguaaguacgaaugcgagacauauaaagaauugaaggcccacgguguuagcugcccccagucccaguguccauacugcuuuacccauugugagcccacugaagcugcguuccaagcacacuauaaagugugccaggugacgcaccgauuuagagacgaucucaagaaaacaguaaccccucagaauuucacuccaggguguuacaggacccugaacuuauuccgguauaagucacguugcuacaucuuuacaaugugggucuuccugcuagugcucgagagcauucugugggccgcuucugccuccgagaccccgcuuaaucccguuuggaacgacaaugcacauggcgugggaagugucccuaugcacacugauuuggaacuggacuuuagccucacaucuuccucaaaguacacguaucgcagaaaacugaccaacccacuugaggaaagucaggccaucaaucugcauauagagaucgaggaacaaacuauuggcguggauguucacgcuuuggggcacugguucgacggaaggcucaaccugaagaccagcuuucauuguuacggugccugcaccaaauaugaguaccccuggcacacagcaaagugucauuaugaacgggauuaccaguaugagacuucguggggcugcaauccuuccgacuguccaggggugggaaccggcugcacggcgugcgguuuauaccuggaccagcuaaaacccguagggucugcuuacaagaucauuaccauccgauauagccgcagagucugugugcaguucggcgaagagaaccucugcaagauaauugauaugaaugacuguuuugugucaaggcacgucaaaguuugcaucauuggaacagugaguaaguucucccaaggcgauacucugcuuuucuucgggccguuggagggagguggccugaucuuuaaacauugguguaccucuacaugccaguucggggacccuggagauauaaugagcccacgggacaagggcuuucucugucccgaauuuccugguuccuuccgcaaaaagugcaacuuugccacuacccccaucugugaguacgaugggaauaugguaucaggcuauaaaaaggugauggcaacgauugacagcuuccagaguuuuaacacaucuaccaugcacuucacugaugaaagaaucgaguggaaggacccagauggaaugcugagggaccacauuuccaucuuagucacaaaagauauagacuuugacaaccugggcgaaaauccuugcaagauugggcuucagaccagcucgaucgagggagccuggggcucaggugugggguacacuuugaccugucucaucucucugacagagugccccacguuccuaaccaguauuaaggcuugcgauaaggccaucuguuauggagcagaauccguuacucugacacguggccaaaacaccgugaaagucagcgguaagggcgggcauucuggaagcuccuuuaagugcugucacggcgaggacugcucacagauugggcuccaugcugccgcgccacaccuggauaaagugaauggaauaagugaaaucgagaacagcaagguuuucgacgauggcgccccgcagugugguauuaaaugcugguuugugaagucuggggaauggaucuccggaauuuucaauggcaacuggaucguccuuauaguauuguguguguuucuguuauucucacucguucugcuuaguauccugugcccugugcggaaacauaaaaagagcuga

SEQ ID NO: 10083 - RNA, 3408 nt, Artificial Sequence
  derived and/or modified CDS sequence (opt3) from HTNV(HV004)__JQ083394.1__GP
augggcaucuggaaguggcuggugauggccagccucgucuggcccgcuuucgcacuuagaaacguuuacgacaugaaaauugagugcccucacaccguguccuuuggggaaaauucuguaauaggauauguggagcugccaccgaugcccuuggccgauacagcgcagauggucccugaaucaaguuguagcauggacaaccaucaauccuuaaauacuaucacgaaguacacccagauuaucuggagggguaaagcugaucagucucagucgucacaaaacagcuucgagacagugaguacugaaguugaccugaaggggaccugcgugcuaaaacacaagauggucgaggaguccuaucggucucgcaagagcauuacauguuacgaucucuccugcaauucaaccuauuguaaaccaacucuguacaugaucgugcccauacaugccugcaacaugaugaagaguugucuuaucgcacugggcccuuaucgaguacagguuguguacgaacguacauacugcaugaccggagucuugauugagggcaaauguuuugugccagaccagagcguggucucuaucauuaagcacgguaucuucgauauagccuccguucauauugugugcuuuuucguagcugugaaagggucaacguauaagcucuuugaacaggucaagaaaaguuucgagaguaauuguaacgacacugagaauaaggugcaaggauacuauaucugcauuguuggcggcaacucugcacccaucuacgugccuacccuggaugacuuuagauccauggaagccuucagcgggaucuuuaaaucgccacacggagaggaucacgaccuggcuggugaagaggucgccucuuauuccauugugggcccggcgaaugcaaagguaccccauucagccaguagcgauacacucuccuuaauagcuuacucugggaucccuagcuauucaagucuguccauucuuacuagcucuaccgaagccaaacacguuuucucaccaggauuguuuccccagcugaaccauacaaagugcgacaaaaccgcaaucccucuaacguggacuggcaugauagaccucccagguuacuacgaggcuauucaccccuguacaguguucugcguccugagugggccgggagccagcugugaggcguucuccgaaggcggcaucuuuaauaucaccucuccuaugugccuugugucgaagcagaacagguuccggcugacugagcagcaagucaauuuugugugucagcgcguugauguggacauuguagucuauugcaacgggcagagaaaggugaucuugacaaaaacccucguuauuggacaauguauauacacgaucaccagccuguucuccuuacugcccgguguggcccacucaauugcagucgaacucugcgugccaggcuuucaugggugggcuacagccgcccuucugguaacuuucuguuuuggauggguguugaucccugcuaucaccuucauuauacuaacaauccugaaguuuauugcaaacaucuuccacacuagcaaucaggagaacaaacucaagucuguucugaggaaaauuaaggaagaguuugagcggaccaagggcagcauggucugcgauguguguaaauaugaaugcgagacauacaaggaacuuaaagcccaugguguguccugcccccagucacaguguccauauugcuucacccacugugagcccacugaagcugcguuucaagcacauuacaaggucugccagguuacgcaccgcuuccgagacgaucugaaaaagacagugaccccucagaauuucacuccaggguguuauagaaccuugaaccucuuuagguacaagagccggugcuacaucuucacaauguggguguuucuguuaguacuggagucuauacuaugggccgcuuccgccagugagaccccgcucaaucccgucuggaacgacaaugcacacggcgugggaagcguuccuaugcauacugaucuggaacuugacuucucuuugacauccucaaguaaauauacguaccgucgcaagcugaccaacccacucgaggaaagccaggccaucaaucugcacauugagaucgaggaacaaacuauuggcguggauguccaugcucuugggcacugguuugacggaagacugaacuugaaaacaucguuccacuguuauggugccugcaccaaguacgaguaucccuggcauacagcaaaaugucacuacgaaagggauuaucaguacgagacuuccuggggcugcaauccuucugacuguccaggggugggaaccggcugcacggcgugcggucucuaccuggaccaguuaaagcccguugggagcgcuuauaagaucauaaccauucgguacucacgacgcguguguguacaguuuggcgaagagaaccugugcaaaaucauugauaugaaugacuguuucgucaguagacaugugaaggugugcaucauaggaacagucuccaaauuuucucaaggcgauacucuacucuucuuugggccgcuggagggagguggccuuaucuucaagcacugguguaccagcacaugccaguuuggggacccuggagauauuauguccccaagggacaaaggcuucuugugucccgaguucccugguucauuucggaagaaaugcaacuucgccacuacccccaucugugaauaugaugggaauaugguuagcggcuacaagaaggugauggcaacgauugacaguuuucagucuuucaacacauccaccaugcauuuuacugaugaacgcaucgaguggaaagacccagauggaaugcugagagaccacauaaacauucucguaacaaaggauaucgacuucgacaaucugggcgaaaacccuugcaaaaucggguuacagaccagcucgauugagggagccuggggcucaggugugggguuuacucugaccugucuuaucucuuugacagagugccccacguuccucaccaguauuaaggcuugcgauaaagccauauguuauggagcagaauccgucacucugacaaggggccaaaauaccgugaagguuagcgguaagggcgggcacucuggaagcuccuuuaaaugcugucauggcgaggacugcucacagaucgggcuacacgcugccgcgccacaucuggauaaggugaacggaauuagugaaaucgagaauagcaaagucuucgacgauggcgccccgcagugugguauuaagugcugguuugugaaaucuggggaauggaucuccggaauauucaacggcaauuggaucguucucauugugcugugugucuuccuuuuguuuucacugguauuacucaguauccugugcccugugcguaagcacaagaaaagcuga

SEQ ID NO: 10084 - RNA, 3405 nt, Artificial Sequence
  derived and/or modified CDS sequence (opt3) from HTNV(NC167)__AB027115.2__GP
auguggggccugcucguggucgccgggcuuaucggacccugcauuagccugagaaacguuuacgacaugaagauagaguguccucacaccgugaauuucggugaaaacuccguaaucggcuauguggaguugccaccgguccccauugcugauaucacacagauggugccugaaucuucaugcaauauggacaaccaucaaaguuuaagcacuuuuacgaaauacacccagcugauuuggaggaagaaagcagagcaggcccaggcgucccaaaauucuuucgaaacaguuucgcgggagguggauuuuaaggggacuugugucuucaaacacaagaugguggaggaaucauauaagaaccgcaaaagcaucauaugcuacgaccuaaguuguaauaucacccauugcaagccaacacucuauaugauuauccccguacacgcuuguaacaugaugaaauccugccugauugcccuuggaccuuuucgaguucagguggucuacgagcguaccuauuguaugucuggcauccugacugaagguagaugcuucgugccauaccagagcguggucuccauaauuaagcaugggaucuuugauauugcaucaauccacaucauuuguuucuuuauagccguugagggaaauacauacaaauuguucgaggaagugaagaagaguuuugcucucaacugcaaugacaccgagaacaaaauccagggcuauuacauuugcaucauaggcgggaauagcgcacccguauaugccccuucuccagaugacuucagguccauggaggcuuuuucaggaauuuuccggagcccgcacggugaaaaccaugaucugaauggcgggcgcaacgcccccuacaguaucgugggaccuacggacggcaaggucccacacucuuccaaacauuauaacaucgaguucgauagcauuuuucaaaaguuccccacuuacucgucuuuuuccauccuggcggguucaguggaaccuaaacacguuuuccagccagggcucuuucccaaguuaaaucacaccaaauguacaaagagugcaauuccgcugguguggacuggaagaauagacaucccuggcuauuacgaggccguccauccccuuaccguguacugcgaauugagcggcccaggggcuuccugugaggccuucucugaaggagguauuuuuaacaucacaagcccuaugugccugguaucaaagcagaauagguuccggagucuacgccagcaaguuuccuuugugugucagcgagucgauauggacaucguggucuauugcaacggccagaaaaagaccauucucacgaaaacucuggugauagggcaauguaucuacacaauuaccagccuuuucucucuguugcccucaguugcacacaguaucgcuguggagcucugcguaccaggauuucauggcugggccacugcggcccuguuaauuacauucuguuuugguuggguccugauccccgcacucaccuucauaauccuuacgauucugaaguucaucgcuaauauuuuucacaccagcaaccaggaaaauaaauugaaggccgugcuaagaaagaucaaagaggaguucgaaaagacaaaaggguccaugguuugcgacauauguaaguaugagugcgauacuuacaaagaacugaaggcucauggccucucuugcccucagucgcaguguccauauugcuuuacccacugugagccgacagaaagcgccuuccaagcacacuacaaggugugccaggucacucauagguuucgggaggagcugaaaaagaccgugacaccccagaacuucaccccuggauguuaucguacucuuaaucuguuucgcuacaaauccagaugcuacauuuucacgauguggaucuugcuccugguauuugaaucaauuuuaugggccgcuagugcgucugacgugccacugagcacagauuggaacgacaaugcacacggcguuggguccguccccaugcauaccgaucuagagcucgacuucucacugacuucuagcuccaaguauaccuacaggcggaaacuuacaaacccuguggauaccagucaggccguggacuugcacaucgaacuggaggagcaaacuauaggacucgauguccacgcucugggucauugguuugacggccgacuuaaucugaagacuagcuuccacuguuauggggccugcacgaaguacgaauauccauggcauaccgcaaaaugucacuuugagcgcgauuuccaguacgaaacuucuuggggaugcaaucccccggacuguccuggcguugguacagggugcaccgccugcggcuuguauaucgaccagcucagaccagugggaaacgcuuacaagauuaucacaauuagguacucccggaaaguguguguacaguucggcgaugagaaccugugcaagacuaucgacaugaacgauuguuuugucucaaaacaugugaagguuugcauaauugggaccgugaguaaauucagccaaggagacacguuacuguuucuaggucccauggaaggcgggggaaucaucuucaagcacugguguaccucgacaugccaguuuggcgauccuggugacauuaugucccccaaggauaaaggguucucuuguccagaguuuagcggcucauuccgcaagaaaugcaauuuugccacuaccccugcaugugaguauggaggcaacauggucaguggguacagaaaggugauggcgacaaucgacuccuuccaggcuuuuaauacuucuaccauucacuucacggaugaaaggauagaguggaaagaccccgauggaaugcuccgugaccauaucaacauucugguuacacgggauaucgacuucgacaaucuugccgaaaacccaugcaagauuggcuugcaagugagcgcaaucgagggugccuggggguccggaguaggcuuuacccugacuugucaggucucacucacagaaugcagcaccuuccugacaaguauaaaggcuugcgauaaagccaucuguuauggugcacagucugugaccuuagugcgaggccagaauacagucaagauuuccgggaaaggaggccacagcgggucggcuuuuaagugcugucauggagaggacugcucacaaacgggccugcaggccgaugcgccgcaccuugacaaaguuaacgguaucucugagguggaaaaugauaagguauacgacgauggggccccugaguguggaauuaagugcugguucgugaaaaguggcgaaugggucgcugguaucuuuuccggcaacuggauaguguugguugugcucuguauuuuccugaucaucagccuaauucugcucucuauacugugccccgucagaaagcauaaaaagagcuga

SEQ ID NO: 10085 - RNA, 3408 nt, Artificial Sequence
  derived and/or modified CDS sequence (opt3) from HTNV(WuhanAaJ10)__JQ665882.1__GP
augggcaucuggaaguggcuggugauggccagccucgucuggcccgcuuucgcacuuagaaacguuuacgacaugaaaauugagugcccucacaccguguccuuuggggaaaauucuguaauaggauauguggagcugccaccgaugcccuuggccgauacagcgcagauggucccugaaucaaguuguagcauggacaaccaucaauccuuaaauacuaucacgaaguacacccagauuaucuggagggguaaagcugaucagucucagucgucacaaaacagcuucgagacagugaguacugaaguugaccugaaggggaccugcgugcuaaaacacaagauggucgaggaguccuaucggucucgcaagagcauuacauguuacgaucucuccugcaauucaaccuauuguaaaccagcccuguacaugaucgugcccauacaugcaugcaacaugaugaagaguugucuuaucgcccugggcccuuaucgaguacagguuguguacgaacguacuuacugcaugacaggagucuugauugagggcaaauguuuugugccagaccagagcguggucucuaucauuaagcacgguaucuucgauauagcuuccguucauaccgugugcuuuuucguagcagugaaagggucaacguauaagcucuuugaacaggccaagaaaucuuuccaaaguaauuguaacgacacugagaauaagguccagggauacuauauuugcaucgugggcggcagcuccgcucccauuuacguuccuacccuggaugacuuuagaagcauggaggccuucucggggcuguuuaaaucuccacacggagaagaucacgaccucgcgggugaggaaguggcauccuauucaaucgucggcccggccaacgcuaaggugccccauagugccagcuccgauacauuaucucugaucgcauacagcgggauuccuucauauaguucccuuagcauauugacuucuucaaccgaggcuaaacacguauucaguccaggacuguuuccccagcuaaaucauacaaagugcgacaaaaccgccaucccucucacguggacuggcaugauugaccugccagguuacuacgaagcgguucaccccuguacaguguucugcguccuuagcgggccgggagccuccugugaggcauucucugagggcggcaucuuuaacauaaccucgccuaugugccuggugagcaagcagaauagguuccgguugacugaacaacaggucaacuuugugugucagcgcguugauguggacauuaucguauauugcaaugggcaaagaaaggucauccucacaaaaacccuggugauuggacaguguaucuacacgauuaccuccuuaauaucacugcuccccgguguugcucacaguaucgccguggagcuuugcgucccaggcucucaugggugggcuacagccgcacuguuggugacuuucuguuuuggauggguacuaauuccugccaucaccuucaucauucugacaauacucaaguuuaucgcuaacauuuuccacacuagcaaccaggaaaauaggcugaaauccgugcuucggaagaucaaagaggaauuugagcgcaccaagggcucaaugguuugcgaugucuguaaguaugagugcgaaacauacaaagagcugaaggcgcauggugugagcugcccccagucucaauguccauauugcuucacccacugugaacccacugaggcagccuuucaggcucauuacaaagugugccaggucacgcaccgauucagagacgauuugaagaaaacaguuaccccucagaacuuuacuccaggguguuauaggacccucaaucuguuccgguacaagucccguugcuacauuuucacaauguggguguuuuuacuggugcuagaaaguauccucugggccgcaagcgccucugagaccccgcugaaccccguauggaaugacaacgcucacggcgucggauccgugccuaugcauacugaucuugaguuggacuucucacugacaaguagcucgaaguauacguaccgcagaaaacucaccaauccacuggaagagucccaagccauagaucuucacaucgaaauugaggaccagacuaucggcguugaugugcaugcacuggggcacugguuugacggaagguugaaccucgagacaucuuuccacuguuauggugcgugcaccaaguacgaauaucccuggcauacagcuaaaugucacuacgagcgggacuaucaguacgaaacuagcuggggcugcucaccuagugauuguccaggggucggaaccggcugcacggccugcggucuguacuuagaccagcugaagcccgugggguccgcauauaaaauuaucaccauacgauacucucgcagaguuugugugcaaagcggcgaggaaaaucuaugcaagauuaucgauaugaacgacuguuuuguauccaggcaugucaaggugugcauuaucggaacagugucaaaauucagccagggcgauacucuccuguuuuucgggccgcuugagggagguggcuugauauuuaagcacugguguaccaguacaugccaguucggggacccuggagauaucaugucuccacgggacaaaggcuuucugugucccgaguucccugguuccuuucgcaagaaaugcaauuucgccacuacccccauuugugaauaugaugggaacauggucagcggcuacaagaaaguuauggcuacgaucgacucguuccagucauuuaauacaucuaccaugcauuucacugaugagagaauugaauggaaggacagggauggaaugcuccgugaccacaucaacauacuggugacaaaggacauugauuuugacaauuuaggcgagaacccaugcaaaaucgggcugcaaaccaguuccaucgaaggagccuggggcagcgguguaggguucacucuuaccuguuugauuucucucacagagugcccuacguuucugaccagcaucaaggcaugcgauaaagcuauuuguuauggagccgaguccgugacucuaacacggggccagaacaccgucaaggugucagguaaaggcgggcacaguggaagcucuuucaagugcugucauggcgaagacugcucccagauagggcugcacgcggccgcuccccaucucgauaagguuaauggaaucucagagauugaaaacaguaaaguguuugacgauggcgcaccacaaugugguaucaagugcuggagcgucaaauccggggaguggauuucuggaaucuucucgggcaauuggauagugcugaucguucuuuguguguuuuugcuguucagcuuaguccuccugucaauucuuugcccgguacgaaagcacaaaaaguccuga

SEQ ID NO: 10086 - RNA, 3408 nt, Artificial Sequence
  derived and/or modified CDS sequence (opt3) from HTNV(Z5)__EU074224.1__GP
augggcaucuggaaguggcuggugauggccagccucgucuggcccgcuugcacccuuagaaacguuuacgacaugaaaauugaguguccucacacaguguccuucggggaaaauucuguaauaggauauguggagcugccaccgaugcccuuggcagauacugcccaguuagucccugaaucaaguugcaacauggacaaucaucaaagcaugaacacgaucaccaaguacacacagguguccuggaggucuaaaguugaucaggcgcaggcuucgcaaaauucauuugaggccgugagcgcagaagucgaccugaaggguacuugugugcuaaaacacaagaugcucgaggagaguuaucggucccgcaagucuauuaccugcuacgaucugagcuguaacuccacauauugcaaaccaacccuuuacaugaucguacccauucaugccuguaauaugaugaagggcugccugaucgcuuuggggccuuaucgaguucagguggucuacgaacguacuuacuguaugacaggagugcucauagagggcaaaugcuucgugccagaccagucagucguuaguaucauuaagcacgguaucuuugauauugcaagcgugcauaucguauguuucuuuguggccgucaaagggaacaccuauaagcuguucgaacaggugaagaaaucuuuucaauccacgugcaaugacacugagaacaagguucagggauacuauauaugcauugugggcggcaauucagcucccaucugugucccuacccuggaugacuucagaagcauggaggccuuuagugggauuuucaggucuccacacggagaagaucacgaccucgcgggugaggaaaucgcauccuacagcaucgugggcccggccaacgcuaaaguaccccauucggccucuuccgauacauuaucacugauugcauauagugggauaccuagcuacuccucucuuagcaucuuggcuggaucaacugaggccaagcacguuuuuaguccaggcuucuuuccccagcugaaucauaccaaaugcgacaagacagcgauuccucuaaccuggacggguaugaucgaccucccaggguauuacgaagccauacaccccuguacuguguucugcguccuguccggaccgggcgcaagcugugaggcuuucucugagggcgggauuuuuaacaucacaucaccuaugugccuugugaguaaacagaaucgguuccgccugaccgaacaacaggucaacuuugugugucagagaguugauauggacaucauuguguacugcaacggacaaaggaagguaaucuugacuaagacacucgucauuggucaguguauauauaccaucacgagccuguucuccuuacugcccggcguggcccacucuauugcuguugagcucugcgugccaggguuucauggaugggccaccgcagcccuucuggucacauucuguuuuggcuggguguugaucccugcuaucacuuucguaauucuaaccauacugaaauuuaucgcgaauauuuuccacacaucgaaccaggguaaucggcucaagagcgugcugaaaaagaucaaagaagaguuugaaaagacuaagggguccaugguuugcgaugucugcaaauacgagugugagaccuauaaggaacuuaaagcacauggcgugucaugcccccagagucaauguccauacugcuucacacacugugagcccaccgaagccgcuuuucaggcccauuaucgcgugugccaggucacucaccgauucagagacgaucugaagaaaacgguuacaccucagaacuucaccccaggauguuacaggacuuugaaucucuuucgguauaagucucguugcuacauuuucaccaugugggugugucuguuagugcuggagagcauccuaugggcagccuccgcuucagaaguaccgcucaaccccauauggaaugacaacgcccacggcgucgggagcgugccuaugcauacagaucuggagcuugacuuuucuuugaccuccaguagcaaguacacuuaucgcagaaggcugacaaauccacucgaggaaacgcaagcaaucaaccugcacauugagaucgaggaacagaccauuggaguugaugugcaugcgcuuggucacugguucgacggccggcugaauuugaaaacuucuuuucacugcuacggggcuuguacaaaguaugaguaccccuggcauaccgccaaaugccacuaugaacgagauuaccaguaugagacauccuggggaugcaacccugcagacuguccaggcgucgguacugggugcaccgccuguggccucuaccuggaccaguuaaagcccgugggaucagcuuacaaaaucauaacgauucgcuauaguagaaagguuugcgugcaauucggcgaagagaaucuguguaagguaaucgauaugaacgacugcuuugucagcaggcaugugaaaguguguauuaucgggaccgucucgaaguucucccagggagauacacuacucuuuuucgguccgcuggaaggcgggggacuuauauuuaaacacuggugcacuucuaccugucaguucggcgacccuggugauaucaugagcccacgggacaagggguuuuugugccccgaguucccuggcucauuccgcaaaaaguguaauuuugccacaacuccccugugcgaguacgauggaaacaugguuaguggcuauaaaaaggugauggcaaccauugacuccuuccagucuuuuaacacgagcacaaugcauuucaccgaugaaagaaucgaguggaaggacccagaugggaugcucagggaccacauuaauauccugguaacuaaagauauagacuuugacaacuuaggagaaaauccuugcaaggugggccugcaaacauccucaauugagggugcuugggggagcggagucggcuucacccuuacuuguuuggugagucucaccgaaugccccacauuucugacgucuaucaaagccugugauaaggcgaucugcuacggugccgaguccguuacccuaacucguggccagaacacagugaaagucagcgggaagggaggccacucggggucaaccuucaaguguugccauggagaggaauguucucagauuggccugcacgcugcagccccacaucucgacaaagugaaugguaucagugagauugaaaacaauaagguuuaugaugacggggcuccgcaaugcggagugaaauguugguuugucaaguccggcgaguggauaagcgguaucuucucuggcaacuggauuguacugaucgugcuuugcguguuuuugcuguucagcuuagcccuccuguccguucuuuguccuguccggcgacacaaaaagucauga

SEQ ID NO: 10087 - RNA, 3408 nt, Artificial Sequence
  derived and/or modified CDS sequence (opt3) from HTNV(ZLS-12)__FJ753399.1__GP
augggcaucuggaaguggcugauuauggccagccucguguggcccgcuuacacccuuagaaacgucuaugacaugaggauagagugcccucacacaguuuccuucggggaaaauucugugaucggauacguagagcugccaccgaugcccuuggcagauacuucacagauggugccugaaaguagcuguuccauggacaaccaucaaucuuuaaauacgauuaccaaauauacacaggucucguggcgggguaaggccgaucagucacaggcgagccaaaacaguuuugaggcuguguccgccgaaguugaccugaaaggcacuugcgugcuaaagcacaaaaugcucgaggagucuuaccgcagccgaaaguccaucaccuguuaugaucugucaugcaauaguacauacuguaagccaacccuuuauaugauuguccccauccaugcaugcaacaugaugaaaagcugucugauagccuuggggccuuaccgugugcagguaguuuacgaaagaacuuauugcaugacaggaauccucauugagggcaaguguuucgugccagaccagucugucguguccaucauuaaacacgguaucuuugauauagcuucagugcauauugucugcuucuuuguugcagugaaggggaauaccuacaaacuguucgaacagguaaagaagaguuuucaaagcacguguaacgacacugaggauaaagugcagggauauuacaucugcauugccggcggcaauucugcucccaucuaugucccuacccuggacgauuucagguccauggaggccuuuagcgggaucuucaagucgccacacggagaagaccacgaucucgcgggugaggaaauugcaucuuacuccauagugggcccggccaacgcuaaaguuccccauucagccaguagcgacacauuaucccugacugcauauucugggaucccuagcuacucaagucuuuccauuuugaccagcucuacagaggcuaagcacguguuuucaccaggauucuuuccccagcugaaucauaccaaaugcgacaagacggccaucccucuaauguggacuggcaugauagaucucccagguuacuaugaagcgauucaccccuguacagucuucugcgugcugagugggccgggagccagcugugaggcauucuccgagggcggcaucuuuaacaucaccucuccuaugugccuuguaucgaaacagaaucgguuccgccugacugaacaacagguuaacuuugugugucagagagucgacauggauauuguggucuacugcaaugggcaaaggaaggugaucuugacaaagacccucguuauuggacaguguauauauacgaucaccagccuguucuccuuacugcccgguguggcucacucaauugccguagagcucugcgucccaggcuuucaugggugggcuacagccgcacuucuggugacuuucuguuuuggauggguuuugaucccugccaucaccuucauuauacuaacaauccugaaauuuauugcuaacaucuuccacaccaguaaccaggaaaaucggcucaagucugugcugcgcaaaauuaaggaggaauuugagaaaaccaagggcagcauggucugcgacguguguaaguacgagugcgaaacauauaaagagcuuaaggcgcaugguguauccugcccccagucacaauguccauacugcuucacccacugugaacccacugaggcagccuuucaggcucauuaucgagugugccagguuacgcacagauucagggaugaccugaaaaagacagucaccccucagaacuucacuccaggguguuaccggaccuugaaucucuuucguuacaaaagccgcugcuauaucuucacaauguggguguuucuguuagugcuggaaucuauacuaugggccgcauccgccagugaggucccgcucagccccguuuggaacgauaaugcucacggcgugggaucuaucccuaugcauaccgaccuggagcuugauuucuccuugacuucaaguagcaaguacacauauagaaggaagcugacgaacccacucgaagagacccaagccauuaaucugcacaucgaaauugaggagcagacuaucggcguggacguacaugcacuugggcacugguuugauggacggcugaacuugaaaacaucguuccacuguuacggugcgugcaccaaguaugaauaccccuggcauacagcuaaaugucacuaugagcgagacuaccaguacgaaacuuccuggggcugcaauccugccgacuguccaggggucggaaccggcugcacggcaugcggucucuaucuggaucaguuaaagcccguggggucugccuacaaaauaauuaccauccgcuauagcagaaggguuugugugcaacugggcgaggaaaaccuaugcaagauuaucgacaugaaugauuguuuugucucacggcaugugaagguuugcauaaucggaacagugaguaaauucucccagggcgacacucuccuguuuuucgggccgcuugagggagguggcuugauuuuuaagcacugguguaccucuacaugccaguucggggauccuggagacaucaugagcccacgcgauaaaggcuuucugugucccgaguucccugguuccuucagaaagaaaugcaacuuugcuacuacuccccucugugaauacgacgggaauaugguaucaggcuauaagaaagucauggccacgauugauagcuuccagaguuuuaacacaucuaccaugcauuucacugacgagaggaucaaguggaaggauccagacggaaugcugcgugaucacauaaauauuuuagugacaaaagacaucgacuuugauaaccugggcgaaaacccuugcaagaucgggcuucaaaccuccgcaauugagggagcuuggggcagcggugugggguucacuuugaccugucucgucucgcugacagaaugccccacguuucuaaccucaaucaaagccugcgacaaggcgauuuguuacggagccgagucuguuacucugacacggggccagaauaccgugaaaguaagugguaagggcgggcacuccggaagccucuucaagugcugucauggcgaggaaugcucucagauagggcugcacgcugcagccccacaucuugauaaagugaacggaaucagcgagauugaaaauaacaaggucuaugacgauggcgcuccgcaauguggugugaaaugcugguuuguuaaguccggggaguggaucucaggaauuuucaguggcaauuggaucguguugauaguccuguguguguuuuuacucuucagccugguucuucugucuguguugugcccuguccgaaaacacaagaaguccuga

SEQ ID NO: 10088 - RNA, 3408 nt, Artificial Sequence
  derived and/or modified CDS sequence (opt3) from HTNV(ZLS6-11)__FJ753397.1__GP
augggcaucuggaaguggcugauuauggccagccucguguggcccgcuuacacccuuagaaacgucuaugacaugaggauagagugcccucacacaguuuccuucggggaaaauucugugaucggauacguagagcugccaccgaugcccuuggcagauacuucacagauggugccugaaaguagcuguuccauggacaaccaucaaucuuuaaauacgauuaccaaauauacacaggucucguggcgggguaaggccgaucagucacaggcgagccaaaacaguuuugaggcuguguccgccgaaguugaccugaaaggcacuugcgugcuaaagcacaaaaugcucgaggagucuuaccgcagccgaaaguccaucaccuguuaugaucugucaugcaauaguacauacuguaagccaacccuuuauaugauuguccccauccaugcaugcaacaugaugaaaagcugucugauagccuuggggccuuaccgugugcagguaguuuacgaaagaacuuauugcaugacaggaauccucauugagggcaaguguuucgugccagaccagucugucguguccaucauuaaacacgguaucuuugauauagcuucagugcauauugucugcuucuuuguugcagugaaggggaauaccuacaaacuguucgaacagguaaagaagaguuuucaaagcacguguaacgacacugaggauaaagugcagggauauuacaucugcauugccggcggcaauucugcucccaucuaugucccuacccuggacgauuucagguccauggaggccuuuagcgggaucuucaagucgccacacggagaagaccacgaucucgcgggugaggaaauugcaucuuacuccauagugggcccggccaacgcuaaaguuccccauucagccaguagcgacacauuaucccugacugcauauucugggaucccuagcuacucaagucuuuccauuuugaccagcucuacagaggcuaagcacguguuuucaccaggauucuuuccccagcugaaucauaccaaaugcgacaagacggccaucccucuaauguggacuggcaugauagaucucccagguuacuaugaagcgauucaccccuguacagucuucugcgugcugagugggccgggagccagcugugaggcauucuccgagggcggcaucuuuaacaucaccucuccuaugugccuuguaucgaaacagaaucgguuccgccugacugaacaacagguuaacuuugugugucagagagucgacauggauauuguggucuacugcaaugggcaaaggaaggugaucuugacaaagacccucguuauuggacaguguauauauacgaucaccagccuguucuccuuacugcccgguguggcucacucaauugccguagagcucugcgucccaggcuuucaugggugggcuacagccgcacuucuggugacuuucuguuuuggauggguuuugaucccugccaucaccuucauuauacuaacaauccugaaauuuauugcuaacaucuuccacaccaguaaccaggaaaaucggcucaagucugugcugcgcaaaauuaaggaggaauuugagaaaaccaagggcagcauggucugcgacguguguaaguacgagugcgaaacauauaaagagcuuaaggcgcaugguguauccugcccccagucacaauguccauacugcuucacccacugugaacccacugaggcagccuuucaggcucauuaucgagugugccagguuacgcacagauucagggaugaccugaaaaagacagucaccccucagaacuucacuccaggguguuaccggaccuugaaucucuuucguuacaaaagccgcugcuauaucuucacaauguggguguuucuguuagugcuggaaucuauacuaugggccgcauccgccagugaggucccgcucagccccguuuggaacgauaaugcucacggcgugggaucuaucccuaugcauaccgaccuggagcuugauuucuccuugacuucaaguagcaaguacacauauagaaggaagcugacgaacccacucgaagagacccaagccauuaaucugcacaucgaaauugaggagcagacuaucggcguggacguacaugcacuugggcacugguuugauggacggcugaacuugaaaacaucguuccacuguuacggugcgugcaccaaguaugaauaccccuggcauacagcuaaaugucacuaugagcgagacuaccaguacgaaacuuccuggggcugcaauccugccgacuguccaggggucggaaccggcugcacggcaugcggucucuaucuggaucaguuaaagcccguggggucugccuacaaaauaauuaccauccgcuauagcagaaagguuugugugcaauuuggcgaggaaaaccugugcaagauuaucgacaugaaugauuguuucgucucaaggcaugugaaaguuugcauaaucggaacagugaguaaguuuucccagggcgacacucuacucuucuuugggccgcuggagggagguggccuuauuuucaaacacugguguaccucuacaugccaguuuggggauccuggagacaucaugagcccacgggauaagggcuucuugugucccgaguucccugguuccuuucgcaaaaagugcaacuucgcuacuacuccccugugugaauacgacgggaauaugguaucaggcuauaaaaaggucauggccacgauugauagcuuucagaguuucaacacaucuaccaugcauuuuacugacgagagaaucgaauggaaggauccagacggaaugcucagggaucacauaaauauucuggugacaaaagacaucgacuucgauaacuuaggcgagaacccuugcaagaucgggcugcaaaccuccgcaauugaaggagcuuggggcagcggugugggguuuacucuuaccuguuuggucucgcucacagagugccccacguuccugaccucaaucaaagccugcgacaaggcgauuuguuacggagccgagucuguuacucuaacacguggccagaauaccgugaaaguaagugguaagggcgggcacuccggaagccuguuuaagugcugucauggcgaagagugcucucagauagggcuccacgcugcagccccacaucuggauaaaguggacggaaucagcgaaauugagaacaauaaggucuaugaugacggcgcuccgcaauguggugugaaaugcugguucguuaaguccggggaauggaucucaggaauuuuuaguggcaacuggaucgugcuuauagucuuguguguguuccuguuauucagccucguucugcuuucugugcugugcccuguccggaaacacaagaaguccuga

SEQ ID NO: 10089 - RNA, 3408 nt, Artificial Sequence
  derived and/or modified CDS sequence (opt3) from HTNV__AB030232.1__GP
augggccuguggaaguggcucauuauggccgugcuugucuggcccugcuucgcucugagaaacguuuacgacaugaaaauugaguguccucacaccgugaauuuuggggaaaacagcguagugggauaugucgaguugccaccgaugcccauagcagauaucacacagaugaugccugaauccucuugcucaauggacaaucaucaaaguuuaaacacuauuacgaaguacacccaggugagcuggaggaaaaaggccgaucgggcgcaguccucucagacaucguucgagacuguuucaagcgaaguggacuuuaaagguaccuguguccugaagcacaagaugguggaggauaguuaucgcucccgaaaaucuaucauuugcuacgaccuaagcuguaauuccacauucugcaagccaacccucuaucugaucguacccguucaugcuuguaacaugaugaaaucaugccuuauagcccugggcccuuaccgugugcaagaugucuaugagagaacuuacuguaugagugggguguugcucgaaggaaagugcuuugugccagacaggagcgucguuucuaucauuaaacacggcaucuucgauauugcauccgugcauaucguaugcuuuuucguggccauaaaggguucaacauacaagauucuggagcaggucaaaaagagcuuugaacugaccuguaaugacacggauaacaaaauccagggguauuacauuugccucgugggaggcaauagugcucccaucuauguuccuacuuuagacgauuuccggucuauggaggcauuugccggcaucuucaaguccccacacggggaggaccacgaccuggcuggagaagagguggccagcuacucgauugucgguccggcgaacgcaaaagugccccauucugccuccgcugauacccuuucauugguagccuuuaguggcauaccuagcuauuccucuuucagcguucugacagggucaacugacgcacgccacguguucaguccaggauuuuucccccagcuaaaucaaaccagaugugauaagacagcuaucccucucaccuggacgggcaugauugaccugccagguuacuaugaagccguccaucccugcacuguguuuuguguccuuuccgggccgggagcgagcugcgaggccuucucugaaggcggcaucuuuaacauaacaucaccuaugugucuggugagugagcagaauagguuccggagcuccgagcagcagguuaacuuugugugccaacgcguagauauggacauugucguguacuguaaugggcagaaaaagguuaucuugaccaagacucucgugaucggacagugcauuuacacaaucaccucucuguucucguuacugcccggugucgcacacagcauugcuguggaacucuguguaccaggcuuucacgggugggccacggcugcccuucuggugaccuucugcuuuggauggguuuugauaccugcagucacucuagugauccugacaauucucaaauucaucgccaacaucuuucauaccuccaaccaagagaaucgacugaagucagugcuuaaaaagauuaaagaagaguucgaaaagacaaagggcaguauggucugugauguuugcaaauaugagugcgagacuuacaaggaacugaaagcucacggugugucuuguccccagagccagugcccauauuguuucacccauugcgagcccacagaagcggcauuucaggcccacuacaaggugugucaaguaacccauagauucagggacgauuugaaaaagacugucacgccucagaacuuuacaccagggugcuaucggacccucaaucuguuccguuacaagucccgcuguuauauauuuacuauguggguguucuuacugauccuagagucaauucucugggcugccagcgcaucugaaaccccguccacacccaucuggaacgacaaugcccacggcguuggaaguauuccuaugcacaccgaucuggagcuugacuuuagcuugacuucuuccucaaaauacacauacagaaggaagcugacgaacccacucgagaaaacccaggcuguggaccugcauaucgaacuugccguccagacuauaggcguggauguucacgcacuggggcauugguucgacggacgguugaaucucaagacaaguuuucacugcuauggugcguguaccaaauacgaguaucccuggcacacagcuaagugccauuacgaacgagauuaucaauacgagacuagcuggggcuguaacccugccgacugcccaggggugggaaccggcugcacggcauguggucuguauuuagaucagcugaagcccguagggucggccuacaaaaucauuaccaucaaguacucccgcagagucugcgugcaguucggcgaggaaaaucuauguaaagugauugacaugaacgauugcuuugucucuaggcacguuaagaucuguauaauuggaacagugagcaaauucucacagggcgacacucuccuguuuuucgggccgcuugagggagguggcuugaucuucaagcauuggugcaccaguacaugucaauuuggggauccuggagacauuauguccccacgggauaaaggcuuccugugccccgaauuuccugguucuuuccgcaagaaguguaauuuugcuacuacccccguaugcgaguaugacgggaacauggugagcggcuacaaaaaggucauggccacgaucgauuccuuccagucauuuaauacaagcaugaugcacuucaccgacgaaagaauagaguggaaagacccagauggaaugcucagggaccauaucaacauucuggugacuaaggauaucgacuuugauaauuuaggcgacaacccuuguaaaguugggcugcagacaagugcaauugagggagcuuggggcucuggugugggguucacccuuacuugccaggucuccuugaccgaaugccccacauuucucacgagcaucaaggccugugauaaggcgauaugcuauggagccgagucgauuacccugacucguggccaaaacacagugaaaguuucagguaagggcgggcacucuggaaguaccuucaaauguugccacggcgaagaguguucccagaucgggcuacaugcugcagccccacaccuggacaaggugaauggaaucagcgaaauggagaacucuaaagucuacgaugacggcgcuccggagugcgguauuaaguguugguucguaaagagcggggaauggaucuccggaauuuuuaauggcaacuggauagugcucaucguucugugcgccuuccuuaucuuuucauuggugcuguuaagucuccuguguccuguccggaaacauaagaaagcauga

SEQ ID NO: 10090 - RNA, 3408 nt, Artificial Sequence
  derived and/or modified CDS sequence (opt3) from HTNV__AB620032.1__GP
augggcauguggaaguggcuggugaucgccagccucgucuggcccguucuugcucugagaaacguguacgacaugaaaauugagugcccucacaccguauccuucggggaaaauucugugauaggauuugucgaguugccaccgaugcccuuagcagauacagcccagauggugccugaaucaaguuguagcauggacaaccaucaauccaucaauacuauuacgaaguauacccagguuacauggagggguaaagcggauccaggccagucuucgcagaacucauucgagacugugagcaccgaagucgaccugaaggggacaugcgugcuaaaacacaagaugguagaggagaguuaccggucccgcaagucuaucaccuguuaugaucucagcugcaauuccacuuacuguaaacccacacuguauaugauuguuccuauccaugcuugcaacaugaugaagucaugucuuauagcccugggaccauaccgagugcaagucguguaugaacguaccuacugcaugacgggcguguugaucgaggguaaauguuuuguccccgaccagaguguugugagcauuaucaagcacgggauuuucgauaucgcaucuguacauauagugugcuuuuucgucgccauuaaaggaaauacuuacaagcucuuugaacaggugaagaaauccuucgagucaaccuguaacgacacagagaauaagguucagggcuauuacaucugcauugugggcgggaacagcgcuccuaucuaugucccaacucuggaugacuuuagaaguauggaagcauucaccggaaucuuuaaaucuccgcacggugaggaucacgaccuggccggcgaagagauugcuuccuacagcauaguggggcccgccaaugcgaagguaccucauucggcaucuuccgauacacucucauuaaucgccuauagugggauuccaagcuacuccucucugagcauccuuaccucaaguacggacgcuaaacacguuuucucccccggcuuguuuccuaagcugaaccauacuaauugcgacaaaagcgccauaccacuaacauggaccgguaugauugaucuccccggguauuacgaagcaauccacccguguacuguguucugcguccugucuggaccuggcgcuucaugugaggccuucagugagggcgggaucuuuaacauuacaagccccaugugccuuguguccaagcaaaauagguuccggcugaccgaacagcaggucaacuuugugugucagcgcguugacauggauaucgugguauacugcaacggacaaagaaaggucauuuugacgaaaacccucgugauaggucaguguaucuauacaauuacuucucuguucucguuacugccaggcguugcgcacagcaucgccguggagcucugcgucccuggguuucauggaugggcaaccgcugcccuucuggugacauucuguuuuggcuggguauugauccccgcugugacuuucguuauucuaaccauacugaaguuugucgccaauaucuuccacacauccaaccaggaaaauaggcucaaaucagugcugcggaagauuaaagaggaauuugagaagaccaaggguaguauggugugcgacgucuguaaauacgagugcgaaacuuauaaggagcuuaaagcacaugggguuucuugcccacaaagccagugucccuacugcuucacgcacugugaaccuacagaggccgcuuuucaggcgcauuauaaggugugccaggugacccaccgcuuccgagaugaccugaaaaagacuguaaccccacaaaacuucacaccgggcuguuacagaaccuugaaucucuuuagguauaagucccggugcuacaucuucacuaugugggucuuucuguuaauucuggaaucagugcuaugggcagccagcgcuucugagacaccccucgccccuguuuggaacgauaaugcacacggagugggcuccgucccaaugcauacggaccuggagcuugauuucaguuugaccagcuccuccaaauacacuuaucgucgcaagcugacaaacccccucgaagaggcccagucaaucgaccugcacauagaaaucgaggagcagaccauugggguggauguucaugcucuuggacacugguuugacgguagacugaauuugaaaacaaguuuccacuguuacggcgccugcacuaaguaugaauacccuuggcauaccgcaaaaugucacuaugagagggacuaccaguaugaaacgagcugggggugcaacccaucggauugucccggagugggcaccgguugcacagcgugcgggcucuaccuggaccaauuaaagccgguaggcuccgcuuacaagaucauuacuauccgguauucucgacgcgucugugugcaguuuggagaggaaaaucugugcaaaauaauugauaugaacgacuguuucgugagcagacaugucaagguuugcaucauuggcaccgugucaaaauuuagucagggggauacacuacucuucuuuggaccucuggaggguggcgggcuuaucuucaagcacugguguacuucuaccugccaguuuggagacccaggcgauauaaugucucccagggacaaagguuucuuguguccugaguuccccgggagcuuucggaagaaaugcaauuucgccacgacaccaaucugugaauacgauggcaacaccguauccggauauaagaaggugauggcaacuauugacucauuucagagcuucaauacaaguaccaugcauuuuacugaugagcgcaucgaauggaaagacccugauggcaugcugagagaccacauuaacauccucgucaccaaggacauagauuucgacaaccugggggagaaucccugcaaaauuggauuacaaacaucuuccaucgaaggcgccugggguagcggggugggauuuacgcugaccugucuuguuucguugacugagugcccaacauuccucaccucaaucaaggcuugcgauaaagccauuuguuacggcgcagagucugugacacugacuaggggucagaacaccgucaaggugaguggcaagggaggacacuccggcagcacguuuaaaugcugucauggggaagacugcucucagaucggacuacacgcugccgcgccgcaucuggauaagguuaauggcauuagcgagauagaaaacuccaaaguguaugacgauggugccccucaaugugggaucaagugcugguucgucaaaucaggagaguggauuaguggcaucuuuagcgguaauuggauuguacucaucgugcuguguguuuuccuuuuguucucucugguguuacucuccauacugugccccguccguaagcacaagaaaucauga

SEQ ID NO: 10091 - RNA, 3408 nt, Artificial Sequence
  derived and/or modified CDS sequence (opt3) from HTNV__D25532.1__GP
augggcaucuggaaguggcuggugauggccagccucgucuggcccguucuuacccugagaaacguguacgacaugaaaauugagugcccucacacaguauccuucgggggaaauucugugauagguuaugucgaauugccaccggugcccuuagcugauacugcacagaugguuccugagucaaguuguagcauggacaaccaucaaucccugaauacgaucaccaaguacacacaggugucuuggaggggcaaagccgaucagucgcagucaagccaaaacaguuuugaaacugucuccaccgagguggaccuaaaggggacaugcguacucaaacacaagaugguugaagagucuuaucggagccgcaaguccgugaccuguuacgaucugucaugcaauaguacuuauuguaaaccaacacuuuacaugauuguccccauccaugcgugcaacaugaugaaaagcugucugauugcuuugggaccuuaucgaguccaggugguguacgagcguaccuacugcaugacgggcguucucaucgaagguaaauguuucgugccagaccagucuguaguguccauaaucaagcacgggauuuuugauaucgccucaguccauauugugugcuucuuuguugcagugaaaggaaauacuuauaagaucuucgagcaggucaagaaaaguuuugaaagcaccuguaacgacacagagaauaaggugcaaggcuacuauauaugcauuguaggcgggaacucugcccccaucuacguuccuacucuggaugacuucagauccauggaggcuuuuaccggaauuuucaggagcccacacggugaagaucacgaccuggcaggcgaggaaaucgccucguauucuaucguggggccggcuaaugccaaagucccccauuccgcgucaagugauacacuccgguuaauugcauacagcggaauaccuuccuauucuagccugucaauccuuaccaguuccacggaggccaagcacguguuuagcccaggcuuguuccccaaacugaaccauacuaauugcgacaagucugcuauuccucuaaucuggacagguaugauagaccucccaggguacuacgaagccguccaccccuguaccguguuuugcguucugucaggaccgggcgcaaguugugaggcuuucagcgagggcgggauuuucaacaucacuuccucuaugugccuugugucgaaacagaaucgcuuuagacugacagaacagcagguaaacuucgucugucaaaggguggauauggacaucguuguguauugcaacggacagcggaaggucauuuugaccaagacgcucgugaucggucaguguauuuacaccauaacaagccuguuuuccuuacugccuggcguagcccacucaaucgcgguggagcucugcguucccggguuccauggaugggccacugcagcccuucuggucaccuuuuguuucggcuggguguugauuccagcuaucacauuuaucauucuaacugugcugaaauucauagcuaauaucuuucacaccaguaaccaagaaaaucgccucaagucuguccugcgaaaaauuaaggaggaauuugagaaaacaaaggguagcaugguuugcgauguguguaaguaugagugcgaaaccuacaaagagcuuaaggcccaugggguguccugcccucagucacagugucccuauugcuucacucacugugaaccaacggaggcagccuuccaggcucauuacaaaguaugccaagucacacacagauuuagggacgaucugaagaaaaccgugacuccccagaacuucaccccuggcuguuaucggacauugaaucucuuccguuacaagagccgcugcuacaucuuuaccauguggauuuuccuguuaguucuggaaucuauccuaugggcggcauccgccagugagacuccacucacaccgguguggaacgacaaugcucacggagucggcagcgugcccaugcauacggaucuggagcuugacuuuucuuugaccuccucaaguaaguauacuuacagaaggaaacugacaaacccucucgaagaggcccagagcauagaucugcacaucgaaauugaggagcagaccaucgggguugacgugcaugcacuuggacacugguucgauggucggcugaauuugaagacaucguuucacuguuauggcgccugcacuaaauacgaauauccauggcauaccgcuaagugucacuacgagcgagacuaucaauacgaaacguccugggggugcaaccccucugacuguccuggaguaggcaccgguugcacagccugcgggcucuaccuggaucaguuaaaaccagucggcagcgcauauaagauuaucacuauacgcuacucaagaagggugugugugcaguucggagaggaaaaucugugcaagauuaucgacaugaacgauuguuuugucagucggcauguuaaagugugcauuaucggcaccguauccaaguucucucagggggacacacuacucuuuuucggaccccuggaggguggcgggcuuauauuuaaacacugguguacuagcacgugccaauucggagauccgggcgacaucauguccccucgcgauaagggguuuuuguguccagaguuccccgggucauucagaaagaagugcaauuuugcgaccacaccuauuugugaauaugacggcaacauggugagcggauacaaaaaggucauggcuaccaucgauaguuuccagucuuuuaauacuuccacaaugcauuucaccgacgagaggauugaauggaaggaucccgacggcaugcugcgugaucacaucaacauacucgugacuaaagacauugacuuugauaaccugggggagaauccaugcaagaucggauuacagaccagcucgaucgaaggcgccugggguucagggguuggauucacacugacgugucuugugucuuugaccgagugcccuacuuuucucacaaguauuaaagcaugcgacaaggccaucuguuauggcgcugaguccgucacccugacacggggucagaacacugugaaaguuagcggcaaggguggacacucuggcagcaccuucaagugcugucauggggaagauugcucccaaauuggacuacacgccgcagcuccccaucuggacaaagugaauggcauaucagagaucgaaaacaguaaggucuacgaugacggugccccacagugugggauuaaaugcugguuuguaaagagcggagaguggaucucuggcauuuucuccgguaauuggaucgugcucauaguucuguguguguuucuuuuguucucacuggucuuacucggcauccugugcccggugcgaaaacacaagaagaguuga

SEQ ID NO: 10092 - RNA, 3408 nt, Artificial Sequence
  derived and/or modified CDS sequence (opt3) from HTNV__L08753.1__GP
augggcaucuggaaguggcuggugauggccagccucgucuggcccgcuuacacccuuagaaacguuuaugacaugaaaauugagugcccucacacaguguccuucggggaaaauucuguaauaggauacguggagcugccaccgauccccuuggcagauacuacgcagauggucccugaaucaaguuguagcauggacaaccaucaauccuuaaauaccgugacaaaguauacucagguuucuuggagggguaaagccgaucaggcgcaggcuucgcaaaacucauuugaggccgugagcgcagaagucgaccugaaggggaccugcgugcuaaaacacaagaugcucgaggagaguuaccggucccgcaagucuauugccuguuaugaucugagcugcaauuccacauacuguaaaccaacccuuuauaugaucguacccauucaugcuugcaacaugaugaagucaugucugaucgcauuggggccucaccgaguucagguggucuacgaacguacuuacugcaugacaggagugcucauagagggcaaauguuucgugccagaccagagugucguuagcaucauuaagcaugguaucuuugauauugccucugugcacaucguaugcuucuuuguggcugucaaagggaauaccuauaagauauucgaacagauuaagaaauccuuugagucaacguacaacgacacuaagaauaaaguggagggauauuacaucuguauuguuggcggcaacagcgcccccaucuaugugccuacccuggaugacuucagaaguauggaagcguuuucugggaucuucagguccccacacggagaggaucaugaccuggccggugaagagauugcaagcuacucgauagucggcccggcuaaugugaagguaccccacucugccuccucagauacacucaguuuaacugcauauagcgggaucccuuccuacucuagccugucaauucuugcuggaagugccgaagcgaaacauguuuuuaguccaggcuucuuuccccaauugaaccacaccaagugcgacaaaacagccaucccucugauguggaccgguaugauagaccuaccaggguacuaugaggcaauucaccccugcacgguguucuguguccucagcggaccgggcgcuucuugcgaggccuucucagaaggcgggaucuuuaauaucacuuccccuaugugucuggugagcaagcagaaccgguuccgccuuacagagcagcaggucaauuuugugugccaaagaguugauauggacauuaucguguacuguaacggacagaggaagguaauucugaccaaaacuuuggucauaggucagugcaucuauacaauuaccucccucuucucucuguuacccggcguggcucauucgaucgccguugaacugugugugccaggguuucacggaugggcaacggccgcucuccuugucaccuucugcuuuggcugggugcugaucccugcgaugacauucauuguauugacuauacuaaaguuuaucgcaaacauuuuccauaccagcaaucaagagaacaaacugaaguccgugcuccggaaaaucaaggaagaguuugagaagacaaaagguucaaugguuugugaugucugcaaguacgaaugugagacuuauaaagaacugaaggcccacggggugaguugcccccagucucagugcccauacuguuucacccauugcgagcccacagaagcugccuuucaggcacacuaucgcgugugucaagucacccaccgauucagagacgaucuuaaaaagacuguuacgccucagaauuucacaccaggcugcuacaggacccugaacuuguuucgguacaagagccguuguuauauuuucacuauguggguguuucuccugguguuagaguccauccugugggccgcuucagccagcgagauaccgcuauaccccguauggaaugacaacgcacauggagucggcucugugccuaugcacaccgaucucgaacuggacuucucccuuacaaguagcucuaaauauaccuaccgcagaaaguugacuaauccacuggaggaaucccaggcgaucaaccuccauauugagaucgaggaacagacaauugggguugaugugcacgcucugggacacugguuugacgguaggcuuaaucugaaaacgucauuccauugcuauggcgccuguaccaaguacgaguaucccuggcacacugcaaaaugccauuacgaucgggacuaccaauaugaaacaaguuggggguguaacccuagcgacugcccaggagucggcaccgguuguacagccugcggguuguaccucgaucagcugaagcccgugggcucggcuuauaagaucauaacuauucgauacucccgcagaguuugcgugcaguuuggagaggaaaauuuauguaaaaucauugacaugaacgauugcuucguaucuaggcacgucaagguguguaucauaggcaccgugagcaaauuuucacagggggacacgcugcuauucuuuggaccgcucgaggguggcgggcugaucuucaagcauuggugcaccaguacaugucaauuuggagauccuggcgacauuauguccccacgggauaaagguuuccuuugccccgaguucccugggucuuuucgcaagaaauguaauuucgccacuacccccuugugcgaauaugacggcaacauggucagcggauacaagaagguuauggcaacaaucgauuccuuucagucauucaauacuagcaccaugcacuuuacggacgagagaauugaauggaaagauccagacggcaugcugagggaucacaucaacauacucgugacaaaggacauugacuucgagaaccugggggaaaauccuuguaaaaucggauuacagaccaguucuaucgagggcgcuugggguuccgggguaggauuuacucugacaugccuugugagcuugaccgagugucccacuuuccucaccucgauuaaggccugcgauaaagcgaucugcuauggcgccgaaucagucacacugacgcguggucagaacaccgugaagguuucuggcaagggcggauacaguggcuccacuuuuaaauguugccauggggaggaauguagccaaauuggacuacacgcugcagccccacaucuggacaaggugaauggcauaucugagaucgaaaacaauaaagucuacgaugacggugcuccgcagugcgggauuaaguguugguucgugaaaagcggagaguggaucuccggcaucuuuucagguaacuggauuguucucauagugcugugcgucuuccuuuuguucagucugaucuuacucagcauucuguguccugcccggaagcacaagaaaucuuga

SEQ ID NO: 10093 - RNA, 3408 nt, Artificial Sequence
  derived and/or modified CDS sequence (opt3) from HTNV__M14627.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccggugcccuuagcugauacugcacagaugguuccugaaucaaguuguaacauggacaaucaucaaagccugaacacgaucaccaaguacacacagguguccuggagggguaaagccgaucagucucagucgucacaaaauagcuuugagacugucaguaccgaaguggaccuaaagggcacaugcguacucaaacacaagaugguugaggaguccuaucggucucgcaagagcgugaccuguuacgaucuguccugcaacucaacuuauuguaaaccaacacuuuacaugauuguccccauccaugcgugcaauaugaugaagaguugucugauugcuuuggggccuuaucgaguccaggugguguacgaacguagcuacugcaugaccggaguucucaucgagggcaaauguuucgugccagaccagucuguaguguccauaaucaagcacgguauuuuugauaucgccucaguccauauugugugcuucuuuguugcagugaaagggaacacguauaagaucuucgaacaggucaagaaaaguuuugagaguacuuguaaugacaccgagaacaaggugcaaggauacuauauaugcauuguaggcggcaauucugcccccaucuacguuccuacacuggaugacuucagauccauggaggcuuuuacugggauuuucaggagcccacacggagaagaucacgaccuggcuggugaagagaucgccucguauucuaucgugggcccggcuaacgccaaagucccccauuccgcgucaagugauacccucagcuuaauugcauacuccgggauaccuucuuauagcucacugaguauccuuacauccagcaccgaagccaagcacguguuuucuccaggauuguuccccaaacugaaucauacgaacugcgacaagucagcuauuccucuaaucuggacuggcaugauagaccucccagguuacuacgaggccguccaccccuguacaguguuuugcguucugagugggccgggagcaagcugugaggcuuucuccgaaggcggcauuuucaauaucaccucuccuaugugccuugugucgaaacagaaccgguuucgccugacugagcagcagguaaacuucgucugucaaagaguggauauggacaucguuguguauugcaaugggcagaggaaggucauuuugacaaagacccucgugaucggacaguguauuuacacgauaaccagccuguuuuccuuacugcccgguguagcccacucaaucgcgguggaacucugcguuccaggcuuccaugggugggccacagcagcacuucuggucacuuuuuguuucggauggguguugauuccugccaucaccuuuaucauucuaacagugcugaaauucauagcuaacaucuuucacacuagcaaucaagagaaccggcucaagucuguccugcgcaaaauuaaggaagaguucgagaaaaccaagggcagcaugguuugcgauguguguaaguaugaaugcgagacauacaaagaacuuaaggcccaugguguguccugcccccagucacaguguccauauugcuuuacccacugugagcccacugaagcagccuuccaggcucauuacaaaguaugccaagucacgcaccgauuuagagacgaucugaagaaaacagugaccccucagaauuucacuccaggguguuauaggaccuugaaccucuuccgguacaagagccguugcuacaucuuuacaauguggauuuuccuguuaguucuggagucuauccuaugggcggcauccgccagugagaccccgcucacucccguguggaaugacaacgcucacggcgucggaagcgugccuaugcauacagaucuggaacuugacuuuucuuugacguccucaaguaaguauaccuaccgcagaaaacugacuaauccacucgaggaagcccagagcauagaucugcacaucgagauugaggaacagacaaucggcguugacgugcaugcacuugggcacugguucgauggaaggcugaacuugaagaccucguuucacuguuauggugccugcacaaaauacgaguaucccuggcauacugcuaagugucacuacgaacgggacuaucaauacgagaccuccuggggcugcaauccuucugacuguccagggguaggaacgggcugcaccgccugcggucucuaccuggaucaguuaaaacccgucgggagcgcauauaagauuaucacaauacgauacucacgcagagugugugugcaguucggcgaagagaaccugugcaagauuaucgacaugaaugauuguuuugucaguaggcauguuaaagugugcauuaucggaacuguauccaaguucucucagggcgacacccuacucuuuuucgggccgcuggagggagguggccuuauauuuaaacacugguguacaagcacuugccaauucggggauccuggagacaucauguccccacgggauaagggcuuuuugugucccgaguucccugguucauuccgcaaaaagugcaacuuugcgaccacgcccauuugugaauaugacgggaauauggugagcggcuacaaaaaggucauggcuacaaucgauaguuuccagucuuuuaacaccuccacuaugcauuucacagacgaaagaauugaguggaaggauccagacggaaugcugagggaucacaucaacauacucgugaccaaagacauugacuuugauaaucugggcgaaaacccuugcaagaucggguuacagacuagcucgaucgagggagccuggggcucagguguuggguucacccugacaugucuugugucuuugacggagugccccaccuuucucacaaguauuaaagcaugcgacaaggccaucuguuauggagcugaauccgucacucugacccguggccagaauacagugaaaguuagcgguaagggcgggcacucuggaagcacuuuccggugcugucauggcgaggauugcucccaaauugggcuacacgccgcagcuccacaucuggacaaggugaacggaauaucagaaaucgagaauaguaaagucuacgaugacggcgccccgcagugugguauuaagugcugguuuguaaaaagcggggaauggaucucuggaauuuucuccggcaacuggaucgugcucauaguucuguguguguuucuuuuguucucacuggucuuacucaguauccugugcccugugcgaaagcacaaaaagagcuga

SEQ ID NO: 10094 - RNA, 3408 nt, Artificial Sequence
  derived and/or modified CDS sequence (opt3) from HTNV__EU074672.1__GP
augggcaucuggaaguggcuggugauggccagccucgucuggcccgcuuucgcacuuagaaacguuuacgacaugaaaauugagugcccucacaccguguccuuuggggaaaauucuguaauaggauauguggagcugccaccgaugcccuuggccgauacaacucagauggucccugaaucaaguuguagcauggacaaccaucaauccuuaaauacgaucaccaaguacacacagauuaucuggagggguaaagcggaucagucucagucgucacaaaacagcuucgagacugugaguaccgaaguugaccugaagggcacaugcgugcuaaaacacaagaugauugaggaguccuaucggucucgcaagagcaucaccuguuacgaucucuccugcaauucaacuuauuguaaaccaacacuguacaugauaguccccauccaugcuugcaacaugaugaagaguugucuuauugcccuggggccuuaucgagugcagguaguuuacgaacguaccuacugcaugacgggaguguugaucgagggcaaauguuuugucccagaccagagcguggugucuauuaucaagcacgguauauucgauauugcauccguccauaucguuugcuuuuucguggccguaaaagggaauacuuauaagauuuuugaacaggugaagaaaucauucgagagcaacuguaaugacaccgagaacaagguccaaggauacuauaucugcaucauuggcggcaauaguucucccguguacguuccuacacucgaugacuuuagauccauggaagcauucagcgggauauuuaggucgccacacggagaggaucacgaccuggcuggugaagagguggccucuuauuccaucgucggcccggcuaacgccaaagugccccauucagcgaguagcgauacucuggggcucauugcauacuccggaaucccuucuuauagcucauuaaguauacugaccuccagcacagaagccaagcacguauucucuccaggccuuuuuccccaguugaaucauaccaaaugcgacaagacggcuauuccucugacuuggacagguaugaucgaccuaccaggguacuacgaggccauccaccccuguaccguuuucugcgugcucucaggaccgggcgcaaguugugaggcuuucagcgaaggcgggauuuuuaacaucacuuccccuaugugccuggucucuaaacagaaucgguuccgccuuacagagcagcaagugaacuuugucugucagagaguggauguugacauuauaguguauugcaacggacagaggaagguaauccugaccaagacguuggucauuggucaauguaucuacaccaucacaagccucuucagccuguuacccggcguggcccacuccauugcgguugaacugugcgugccaggguuucauggaugggccacugcagcucuccuugucaccuucuguuuuggcugggugcugauaccugccaucacauucauuaucuugacuauucuaaaauuuaucgcuaauauauuccacaccucaaaccaggagaaucggcugaagaguguacuccgcaaaaucaaggaagaguuugagcgaacaaaagguucuauggugugcgauauuuguaaguaugaaugcgagaccuacagagaacugaaggcccaugggguuagcugcccccagucccaguguccauauugcuucacucacugugagcccacggaagcagccuuucaagcucauuacaaagucugccaggugacacacagguuccgggacgaucuuaagaaaaccgugacuccucagaacuucaccccaggcuguuaucguacacugaauuuguuucgcuacaagucaagaugcuacaucuucaccaugugggucuuucuccugguuuuagagagcauucugugggcggcaucugccuccgagaucccgcuaaaccccguguggaaugacaacgcucacggagugggcaguauaccuaugcauacugaucucgaacuggacuucagccuuacaucuuccucaaaauauacguacaggcggaaguugaccaauccacuggaggaaagucaggccauugaucuccacguagagaucgaggaacaaacuauuggggucgacgugcaugcacugggacacugguuugauggucgacuuaaccugaagacaucguuccacuguuauggcgccugcaccaaauacgaguaucccuggcauacagcuaagugucacuacgaacgcgacuaucaguacgagacuucgugggggugcaauccuuccgacuguccaggaguuggcaccgguugcacggccugcggguuguaccucgaucagcugaaacccgugggcucugcauauaagaucauaaccaucagauacagcaggcgggucugugugcaguuuggagaagagaacuuaugcaaaauuaucgacaugaaugauuguuucguuucacgccaugugaagguaugcauuaucggcacagucaguaaguuuucccaaggggacacucugcuauucuuuggaccgcucgaggguggcgggcugauauucaaacacugguguaccucuacaugccaguuuggagauccuggcgacauuaugagcccaagagauaaggguuuccuuugucccgaguucccuggguccuuuaggaaaaagugcaacuucgcgacuacccccgugugugaauaugacggcaauauggugucaggauacaaaaaggucauggcuacgaucgauagcuuucagaguuucaacacaucuaccaugcauuuuacugacgaacguaucgaguggaaagauccagacggcauguugcgggaucacauuaacauccugguuacaaaggacauugacuucgauaaucucggggaaaacccuugcaagauaggacugcagaccuccagcaucgagggcgccugggguucgggggugggauuuacuuuaaccugucugauuucacuuacagagugcucuacguucuugaccaguaucaaagcaugcgacaaggccauuuguuauggcgcugaauccguaacucucacacgaggucaaaauaccgugaaagucagcggcaaagggggacacucuggcagcuccuuuaagugcugucauggggaggaaugcucacagaucggacugcacgccgcagcuccccaucuagauaaggugaacggcauaagugagauggaaaauagcaagguuuucgacgauggugccccacagugugggaucaaaugcugguuugugaagucuggagaguggauuuccggcaucuucucagguaacuggauuguccugaucgugcucuguguuuuccugcuuuuuaguuuggugcuguuaagcauacucugcccggucagaaaacacaagaaauccuga

SEQ ID NO: 10095 - RNA, 3408 nt, Artificial Sequence
  derived and/or modified CDS sequence (opt3) from HTNV__GQ120966.1__GP
auggagaucuggaaguggcuggugauggccagccucgucuggcccgcuuucacccuuagaaacguuuacgacaugaaaauugaaugcccucacacaguguccuuuggcgaaaauucuguaauaggguauguggaacugccaccgaugcccuuggcagauacugcccagauggucccugagucaaguuguaacauggacaaucaucaaagcaugaacacgaucaccaaguacacacagguguccuggaggggaaaagcggaucaggcucaggccucucaaaauucguucgaagcaguuucagccgagguggacuuaaaggguacuugcguccugaaacacaagaugcuagaggaaagcuaucggagucgcaaguccauuaccuguuacgaucucucuugcaacagcacauauuguaaaccaacccuguacaugaucgugcccauucaugcuugcaauaugaugaaguccugucuuaucgcacugggcccuuaucgaguacagguuguguacgagcguacuuacugcaugacaggggucuugauagaaggaaaauguuuugugccagaccagucaguggucaguaucauuaagcacggcaucuucgauauugccagcguucauaucgugugcuuuuucguagcugugaaagguaacaccuauaagcucuuugagcaggucaagaaaucuuuccaauccacguguaaugggacugagaacaaggugcagggauacuauauaugcauuguuggcggcaauucagcccccaucuacgugccuacccuggacgauuuuagaagcauggaagcguucagugggauuuuuaggucuccacacggagaggaccacgaucuggccggugaagagaucgcauccuauagcaucgucggcccggcuaacgccaaagugccccauucggcaucuuccgacacacucucauuaauugcuuacagugggauaccuagcuauuccucucugagcauccuugccucaaguacugaagcgaagcacguauucuccccaggauuuuucccccaguugaaucauaccaaaugcgauaagacagccauuccucugaccuggacgggcaugaucgaccuaccagguuacuacgaggcaauacaccccuguacuguuuucugcgugcucagcgggccgggagcuucuugugaggccuuuucagaaggcggcauuuucaacaucacaaguccuaugugccuggucagcaaacagaaucgguuucgccuuaccgagcaacaggugaacuucgucugucagagaguggacauggauaucauuguuuauugcaacgggcaaaggaaggugauccugacuaagacauugguaauuggacaguguauauacaccaucacgucccucuuuucucuguuacccggugucgcucacucgauugccguggaacugugcguuccaggcuuccaugggugggcaaccgccgcucuccuugugacauuuuguuucggauggguccugaucccugcguugacucuaaucauucugaccauacucaaauuuaucgcaaauauuuuccacacaagcaaccaggagaaucggcugaaguccgugcuucgcaaaaucaaggaagaguuugagaaaacuaagggcucaaugguaugcgacguguguaaguaugaaugcgagaccuacaaagaacugaaggcccaugguguuaguugcccccagucucaauguccauauugcuucacacacugugagcccaccgaagcugccuuucaggcacauuaccgagucugccaggugacucacagauucagggaugacuugaaaaagacggugacaccucagaacuucaccccaggguguuaucggacucucaaucuguuucguuacaaaagccgcugcuacauuuucaccaugugggucuguuuacugguucuagaguccauccucugggccgcuucagccagcgaggugccgcugaaccccguguggaaugauaacgcacacggcguaggaucugucccuaugcauacagaccuugaauuggauuuuccacugaccuccaguagcaaguauacuuacagaaggcggcucacaaauccccuggaggaaacgcaaucuauaaaccuucacaucgagauugaggaacagaccaucggcguggacguucaugcgcuggggcacugguucgauggacgauugaaucucaagacuuccuuucacugcuauggugcuuguacaaaauacgaguauccuuggcauaccgccaagugccacuacgaacgcgacuaucaguacgagacaucauggggcuguaacccagcagauugccccggggugggaacuggcugcaccgccuguggucuguacuuagaccagcugaaaccggucgggagugcuuauaagauuaucacgauaagauacagcaggaaagugugcguucaauucggcgaagagaaucuauguaaggugauugacaugaacgauugcuuuguaacccggcaugucaagguguguaucauuggaacagugucgaaauucucccagggcgacacucuccuguuuuucgggccucuugagggagguggcuugaucuuuaagcacuggugcaccucuacaugucaguucggggauccaggagacauaaugagcccccgcgauaaaggcuuucugugcccugaguuccccgguucauucagaaagaaauguaauuuugccacuaccccacucugcgaguaugacgggaacauggucaguggcuacaagaaaguuauggcaacgaucgauuccuuccagucuuuuaacacaagcaccaugcauuucacugacgaaaggauugaguggaaggauccugacggaaugcugcgugaucacaucaauauuuuagugacaaaggacaucgauuuugacaaccugggcgaaaaucccuguaaaauagggcuucaaaccuccucaauugagggagcuuggggcagcgguguaggguucacuuugaccugccucaucagucugacagagugcccaacguuucuaaccucuaucaaggccugugacaaagcgauuugcuauggagccgaauccgugacucugacacggggccagaacaccgucaaggugagcgguaaaggcgggcacucgggaucaacauucaaguguugccauggcgaggaauguucucagaucgggcuccacgcugcagccccgcaucuggauaagguuaauggaauuagugagauagaaaacaauaaaguguacgacgauggcgcuccucaaugcggugucaaguguugguuugugaaauccggggaguggaucagcggaauuuucucuggcaacuggaucguucuuauuguguugugcgucuuucuguuauucagccucguacugcuuuccgugcugugucccguucgaaagcacaaaaagucauga

SEQ ID NO: 10096 - RNA, 3408 nt, Artificial Sequence
  derived and/or modified CDS sequence (opt3) from HTNV(CGAa1011)__EF990927.1__GP
auggagaucuggaaguggcuggugauggccagccucgucuggcccgcucuugcacugagaaacguucacgacaugaagauugaaugcccucauaccguguccuucggcaagaauagcguaauaggguacguggaguugccaccgaugcccuuagccgauacaauccagauggucccugaaucaaguuguagcauggacaaccaccaaucccugucuacugugacgaaauauacccagguuucguggaggggaaaggcggaucaggcucagucaaaucaaacuagcuuugagacagugagugucgaaguggaccuaaaagguaccugcguacucaagcauaagcugguugaggaguccuaccggucucgcaaaagccuuacauguuaugaucuguccugcaacucaaccuacuguaagccaacuuuguauaugauugugcccauccacgccugcaauaugaugaaaaguuguauuaucgcacucggcccucaucgaguccaggugguguacgaacguacauauugcaugaccgggguccugcuggagggaaaguguuucguuccagaccagagcgugguaggcauagugaaacacgguaucuuugauauugccucuguccacaucgcuugcuucuuuguggcaauuacggggaacacuuacaaacucuucgaacagguuaagaaauccuuuggaaccacauguaaugacacugagaacaaggugcaaggcuacuauaucugcauauuaggcggaaauucacccccuauuuacgucccaacccuggaugacuucagaagcauggaggccuuuaguggaaucuucaaaucuccgcauggugaagaucacgaccuugcuggcgaggaaauugccuccuauagcaucguggggcccgcgaacgcaaagguaccucauucggccucuuccgauacauugucacugaucgcuuuuagugggauuccaagcuacuccucucuaagcauacucaccucaaguacggaggccaaacacguuuucucccccggccuguuuccucagcuuaaucacacuaagugcgacaaaacagcaaucccacugaccuggacugguauuaucgacuugcccggguauuacgaagcugugcauccguguacagucuucugcgugcucagcggaccuggcgccucuugugaggcguucucagagggcgggauauuuaacauuaccagucccaugugccuggucagcaagcagaauagguuccgguuaacggaacagcaagugaacuuuguuugucagcgcguggauauggacaucguagucuauugcaauggacagagaaaggugauccugaccaaaacacucguuauuggucaauguaucuacacuauuaccucccuuuucucucuguugccaggcguggcccacucgauagcagucgagcuaugcgugccuggguuucauggaugggcuacagccgcucugcucaucacuuucuguuuuggcuggguacugauucccgcccuuaccuucaucgugcugacaguuuugaaguuuaucgcaaacauuuuccacaccagcaaccaggaaaauaggcucaaaaugguccugaagaaaauaaaggaggaauuugagcggacuaaggguuccauggugugcgauaucuguaaauacgagugcgaaacguauaaggaguuaaaagcccauggggugucaugcccacagagucagugucccuacugcuucacacacugugaaccuaccgagucugcuuuucaagcgcacuaucgcgucugccagguuacucaucgauucagagacgaucugaagaaaaccgugacaccacagaacuucaccccgggcuguuacaggacucuaaaucucuuucgguauaagagccguugcuacauuuucacaauguggaucugucugcuuguguuggaauccauucugugggcagccucagcuagcgagaucccccucucuccuacguggaacgacaaugcccacggaguaggcuccauaccaaugcauaccgaucuggagcuugacuuuagucugacuucuucuuccaaguauacauaccgcagaaaauugaccaacccccucgaagagucacaggcagucaauuuccacguggaaaucgaggagcaagccauugggguugaugugcacgcucugggacauugguuugacgguagguuaaaccugaagacaaguuuccacugcuacggcgccuguacuaaauaugaauacccuuggcauaccgcaaagugccacuaugagcgggauuaccaguaugaaacgagcuggggguguaauccaucggacugccccggagucggcaccgguugcacagcgugugggcuauaccucgaccagcugaaaccggugggcuccgcuuauaagaucauuacuauccgauacucucgcagaguuugcgugcaguuuggagaggaaaaccuuuguaagguaauagauaugaaugacugcuucgucagcaggcaugugaaaguguguauuaucggcaccgucucaaaguuuagucaaggggauacauugcuguucuuuggaccucucgaggguggcgggcugauuuucaaacacuggugcacuuccaccugucaguuuggagacccaggcgauaucaugucuccccgggacaaggguuucuuaugcccugaguuccccgggagcuuucgcaaaaaguguaacuucgccacgacaccaguuugcgaauacgauggcaauaugguguccggauauaaaaagguaauggcaaccauagacucauuucagagcaguaacacuucuacaaugcacuucaccgaugagagaaucgaauggaaggacccugauggcaugcugagggaccauauuaauauccuugugacuaaagauauugacuuugacaacuugggggagaaccccuguaagaucggacuccagaccuccagcauagaaggcgccugggguucgggggucggauucacacugacgugccuaauuucacugaccgagugcccaacuuuucucacaucuaucaaggcuugugauaaggccaucugcuacggcgcagagagugugacccugacacguggucaaaauacuguuaaaguguccggcaaagggggacacagcggcucuaccuucaaguguugccauggggaagacuguagccaguccggacuucacgcugccgcgccgcauuuggauaaggucaacggcauuucagagaucgaaaauaguaagguguaugacgauggugccccucagugcgggguuaaauguugguuugucaagagcggagaguggauuucuggcauauucuccgguaacuggaucgugcugauuguauuaugcguguuucuccuguucucacuuguucuguugaguauccucugucccgugcggaaacacaaaaagagcuga

SEQ ID NO: 10097 - RNA, 3408 nt, Artificial Sequence
  derived and/or modified CDS sequence (opt3) from HTNV(CGAa2)__EU092223.1__GP
auggagaucuggaaguggcuggugauggccagccucgucuggcccgcccuugcacugagaaacguucacgacaugaaaauugaaugcccucauaccguguccuucggcaaaaauucuguaauaggguacguggaguugccaccgaugcccuuagccgauacaauccagauggucccugaaucaaguuguagcauggacaaccaccaaucccugucuacugugacgaaguauacccagguuucguggaggggaaaggcggaucaggcucagccaucacaaacauccuuugagacugugagugucgaaguggaccuaaaagguaccugcguacucaagcauaagcugguugaggaguccuaccggucucgcaaaagccuuacauguuaugaucuguccugcaauucaaccuacuguaagcccacuuuguauaugauugugccuauccacgccugcaacaugaugaaaaguuguauuaucgcacucggcccacaucgaguccaggugguguacgaacguacauauugcaugaccgggguccugcuggagggaaaguguuucguucccgaccagagcgugguaucuauagugagacacggcaucuuugauauugccuccguccacaucgcuugcuucuuuguggcaauuacggguaauacuuacaaacucuucgaacagguuaagaagucauuugggaccacauguaacgacacugagaauaaagugcaaggauacuauaucugcauauuaggcggcaacagcccuccaauuuacgucccgacccuggaugacuucaggaguauggaggccuuuucugggaucuucaagagcccccauggagaagaucacgaccuugcuggugaggaaauugccagcuauucgaucgugggcccugcgaaugcaaaaguaccacauucugccuccucagauacauugagucugaucgcuuuuagcgggauucccuccuacucuagccuaucaauacucaccaguuccacggaggccaagcacguuuucagcccuggacuguuuccacagcuuaaccacacuaaaugcgacaagacagcaaucccccugaccuggacuggcauuaucgacuugccggguuauuacgaagcugugcauccuuguacagucuucugcgugcucucugggcccggagccucaugugaggcguucagugagggcggcauauuuaauauuaccagcccaaugugccuggucuccaaacagaaccgguuccgcuuaacggaacagcaagugaauuuuguuugucagagaguggauauggacaucguagucuauugcaacgggcagaggaaggugauccugaccaagacacucguuauuggacaauguaucuacacuauuaccucucuuuucucgcuguugccugguguggcccacagcauagcagucgagcuaugcgugcccggcuuucaugggugggcuacagccgcucugcucaucacuuucuguuuuggauggguacugauuccagcccuuaccuucaucgugcugacaguuuugaaauuuaucgcaaauauuuuccacaccuccaaccaggaaaaccggcucaagaugguccugaaaaagauaaaagaggaauuugagcgcacuaagggcucaauggugugcgauaucuguaaguacgagugcgaaacguauaaagaguuaaaggcccauggugugaguugcccccagucucaguguccuuacugcuucacacacugugaaccaaccgagagcgcuuuucaagcgcacuaucgagucugccagguuacucauagauucagggacgaucugaaaaagaccgugacaccgcagaauuucacccccggguguuaccggacucuaaaccucuuucguuauaaaucccgcugcuacauuuucacaauguggaucugucugcuuguguuggaaucaauucugugggcagccagcgcuucugagaucccucucuccccaacguggaaugacaacgcccacggcguaggaaguauacccaugcauaccgaucuggagcuugacuuuagccugacuucuuccucaaaguauacauacagaaggaaguugaccaauccucucgaagagagucaggcagucaacuuccacguggaaaucgaggagcaagccauuggcguugaugugcacgcucuggggcauuggagcgacggacgguuaaaucugaaaacaucguuucacugcuacggugccuguacuaaguaugaauacccauggcauaccgcaaaaugccacuaugagcgagauuaccaguaugaaacguccuggggcuguaaccccucugacugcccgggggucggaaccggcugcacagcguguggucuauaccucgaccagcugaagccuguggggagcgcuuauaaaaucauuacuauccgcuacucaagaaggguuugcgugcaguucggcgaggaaaaucuuuguaagguaauagauaugaacgacugcuuugucagucggcaugugaagguguguauuaucggaaccgucuccaaauucucucaaggcgauacauugcuguuuuucgggccacucgagggagguggccugauuuuuaagcacuggugcacuagcaccugucaguucggggaccccggagauaucauguccccucgcgacaaaggcuuuuuaugccccgaguucccagguucauucagaaagaaauguaauuuugccacgacaccuguuugcgaauacgaugggaacauggugagcggcuauaagaaaguaauggcaaccauagacaguuuccagucuuccaauacuagcacaaugcacuuuaccgaugagaggaucgaauggaaggaccccgauggaaugcugcgugaccauauuaacauccuugugacuaaggauauugacuucgacaauuugggcgagaacccauguaaaaucgggcuccagaccucgucaauagaaggagccuggggcucuggugucggguuuacacugacgugccuaauuagucugaccgagugcccgacuuuccucacauccaucaaggcuugugauaaagccaucugcuacggagcagagagcgugacccugacacggggccaaaacacuguuaaggugucugguaaaggcgggcacagcggauccaccuuuaaguguugccauggcgaagacuguucacagagugggcuucacgcugccgcgccucauuuggauaaggucaauggaauuagcgagaucgaaaacucuaaaguguaugacgauggcgcuccccagugcgguguuaaguguugguucgugaaauccggggaguggauuucaggaauauuuaguggcaauuggaucguccugauuguauuaugcguguuccuccuguuuagccuuguucuguuguccauccucuguccagugcgaaagcacaaaaagucuuga

SEQ ID NO: 10098 - RNA, 3408 nt, Artificial Sequence
  derived and/or modified CDS sequence (opt3) from HTNV(CGAa31MP7)__EF990925.1__GP
augggcaucuggaaguggcuggugauggccagccucgucuggcccgcuuucgcacuuagaaacguuuacgacaugaaaauugagugcccucacaccguguccuuuggggaaaauucuguaauaggauauguggagcugccaccgaugcccuuggccgauacaacucagauggucccugaaucaaguuguagcauggacaaccaucaauccuuaaauacgaucaccaaguacacacagauuaucuggagggguaaagcggaucagucucagucgucacaaaacagcuucgagacugugaguaccggcguugaccugaaggggacaugcgugcuaaaacacaagaugauugaagaguccuaucggucucgcaagagcaucaccuguuacgaucucuccugcaauucaacuuauuguaaaccaacacuguacaugauaguccccauccaugcuugcaacaugaugaagaguugucuuauugcccugggaccuuaucgagugcagguaguuuacgagcguaccuacugcaugacgggcguguugaucgaagguaaauguuuugucccagaccagagcguggugucuauuaucaagcacgggauauucgauauugcauccguccauaucguuugcuuuuucguggccguaaaaggaaauacuuauaagauuuuugaacaggugaagaaaucauucgagagcaacuguaaugacaccgagaacaagguccaaggcuacuauaucugcaucauuggcgggaauaguucucccguguacguuccuacacucgaugacuuuagauccauggaggcuuucagcggaauauuuaggucgccacacggugaagaucacgaccuggcaggcgaggaaguggccucuuauuccaucgucgggccggcuaacgccaaagugccccauucagcgaguagcgauacucugggacucauugcauacuccggcaucccuucuuauagcucauuaaguauacugaccuccagcacagaggccaagcacguauucucuccaggucuuuuuccccaguugaaucauaccaaaugcgacaagacggcuauuccucugacuuggacagggaugaucgaccuaccaggauacuacgaagccauccaccccuguaccguuuucugcgugcucucaggcccgggcgcaaguugugaggcuuucagcgaagggggaauuuuuaacaucacuuccccuaugugccuggucucuaaacagaaucgguuccgccuuacagagcagcaagugaacuuugucugucagagaguggauguugacauuauaguguauugcaacggucagaggaagguaauccugaccaagacguuggucauuggccaauguaucuacaccaucacaagccucuucagccuguuacccgggguggcccacuccauugcgguugagcugugcgugccaggauuucauggcugggccacugcagcucuccuugucaccuucuguuuugguugggugcugauaccugccaucacauucauuaucuugacuauucuaaaauuuaucgcuaauauauuccacaccucaaaccaggaaaaucggcugaagaguguacuccgcaaaaucaaggaggaauuugagcgaacaaaagggucuauggugugcgauauuuguaaguaugagugcgaaaccuacaaggagcugaaagcccauggcguuagcugcccccagucccaguguccauauugcuucacucacugugaacccacggaggcagccuuucaagcucauuacagagucugccaggugacacacagguuccgggacgaucuuaagaaaaccgugacuccucagaacuucaccccaggauguuaucguacacugaauuuguuucgcuacaagucaagaugcuacaucuucaccauguggauuugucuccuggucuuagaaagcauccugugggcggcaucugccuccgagauaccgcuaaaccccguuuggaaugacaacgcucacggcguggggaguauuccuaugcauacugaucucgagcuggacuuuagccuuacaucuuccucaaaacacacguauaggcggaaguugaccaauccacuggaagagagucaggccaucgaucuccauguggaaauugaggagcaaacuaucggaguagacguccacgcacugggucacugguucgauggccgacuuaaccugaagacaucguuucauugcuacggggccuguaccaaauaugaauaccccuggcacacagcuaagugccauuaugagcgcgacuaccaguaugaaacuucguggggauguaauccuuccgacugcccaggcguggguaccgggugcacggccuguggcuuguaccucgaucagcugaaacccguuggaucugcauacaagauaaucaccauuagauauagcaggcgggugugcguccaguucggcgaggaaaacuuauguaaagugaucgacaugaaugauugcuuuguuucacgccacgugaagguauguauuaucgggacagucaguaaguucucccaaggagacacucugcuauuuuucgguccgcucgagggcgggggacugauauuuaaacauuggugcaccucuacaugucaguucggcgauccuggugacauuaugagcccaagagauaagggguuucuuugccccgaguucccuggcuccuucaggaaaaaguguaacuuugcgacuacccccgugugcggauacgacggcaauauggugucaggguauaaaaaggucauggcuacgaucgauagcuuccagaguuuuaacacaucuaccaugcacuucacugacgaacguaucgaguggaaagauccagacggaauguugcgggaucacauuaacauccugguuacaaaggacauugacuuugauaaucucggcgaaaacccuuguaagauaggucugcagaccuccagcaucgagggggccuggggaucgggcguggguuucacuuuaaccugccugauuucacuuacagaaugccccacguuuuugaccucuaucaaagcaugugacaaggccauuugcuacggcgcugagaguguaacucucacacgagggcaaaauaccgugaaagucuccggaaagggcgggcauagcggaucuacauucaaauguugccacggcgaggauuguagccaguccggucugcaugccgcagcuccacaccuagacaaggugaacgggaucucagaaauagagaauaguaagguuuaugaugacggagccccgcagugcggcaucaaauguugguuugucaagagcggugaauggauuucuggcaucuucuccgggaacuggauugugcugaucgugcucugcguuuuucugcuuuucucauuggugcuguuaaguauacucuguccugucagaaaacauaagaaaagcuga

SEQ ID NO: 10099 - RNA, 3408 nt, Artificial Sequence
  derived and/or modified CDS sequence (opt3) from HTNV(CGAa4MP9)__EF990929.1__GP
auggagaucuggaaguggcuggugauggccagccucgucuggcccgcucuugcacugagaaacguuuacgacaugaaaauugaaugcccucacaccguguccuucggcgaaaauucuguauugggguauguggaauuaccaccgaugccccuggccgauacaauacagauggucccugagucaaguuguagcauggacaaccaucaauccaugucuacugcgacgaaguacacccaggugucguggaggggaaaagcugaucaggcccagucaagccaaacaaguuuugaaacuguuuccguggaggucgaccuaaaggguaccugcgugcucaaacacaagaugguagagaagucuuaucggagccgcaaaucccugacauguuacgaucuuucaugcaauaguaccuauuguaagccaacucuguacaugaucguucccauucaugcaugcaacaugaugaaaagcuguaucauugccuugggcccuuaucgagugcaggucguguacgaacguacauacugcaugaccggggugcuccuggagggaaaguguuucgucccagaccagucuguuguguccaucguaaaacacucaauauuugauaucgcuagcgugcauauugcaugcuucuuugucgccaucacgggcaauacuuauaagcugauugaacaggugaagaccaguuucgguacaacuuguaacgacaccgaggauaaaguucaaggguacuauaucugcauacucggaggcaauucucccccuauuuacgugccaacauuagacgauuuuagauccauggaggcuuucagcggcaucuuuaggucgccgcacggggaagaccacgaucuggccggagaggaaauugcgucuuauuccaucgucggucccgcaaacgccaagaucccucauucagcuaguagcgacacccuuuccuugauugccuucucuggcauaccaagcuacucaagucuguccauccuaacgagcucuacugaggcaaaacacguguuuucacccgggcuuuucccucagcugaaucauacaaagugcgacaaaaccgcuauuccacuuacuuggacaggaaucauagaucugcccggcuauuacgaagccguacacccguguaccguguuuugcguuuugagugguccuggggcgagcugugaggccuucuccgagggaggcauuuucaacaucacgucucccaugugccucgucucgaagcagaaucgguuucgccugaccgaacagcaagugaacuucgucugucagagaguggacauggauaucguuguguacugcaauggccagaggaaaguaauuuuaacaaagacucuggucaucgggcaauguauuuauaccauaacaagccucuuuucccuucugccaggaguggcacacucaaucgcuguugaguugugcgugccugguuuccauggcugggccacugcugcccuacuggucaccuuuuguuucgggugggugcucauucccgcaaucacauuuguagugcugaccguucuuaaguucaucgccaacauuuuucacacuuccaaucaggaaaaccggcugaaaauggucuugaagaaaauaaaggaggaguucgagaaaacgaagggaucuauggugugcgacaucuguaaguacgagugcgaaacauauaaagagcucaaggcucauggcgugagcugcccacagucccagugucccuacugcuuuacccacugugaaccuacugagucagcguuccaagcacauuaucgcgucugccagguuacccaccgauuuagagaagaucugaaaaagacagugaccccacagaacuucacuccggguuguuacaggacauuaaaucuguuccgguauaaaagccguugcuacauuuuuacgauguggaucuuccuacucgugcuggagucuauucuuugggccgcuuccgccagugagacccccuugagcccuacuuggaacgacaaugcacacgggguaggcucuaucccaaugcauacagaucuggaacucgacuuuucccugaccucaaguagcaaguacacauaucgcagaaagcucacuaacccccuggaggaagcccaggcugucucguuccacguggagauagaggaacaaaccaucggaguugaugugcaugccuugggccacugguuugacgggaggcucaaucugaaaacguccuuccacuguuacggagcaugcaccaaguaugaguacccuuggcauacagcgaaaugucacuaugaacgggauuaccaguaugagacuucuugggguugcaacccaagcgacugucccggcgucgggaccggaugcacagcuugcggcuuauaccuggaccagcuaaagccgguggguucagccuacaaaauuaucacuauucgauauagucgcagaguuugugugcaguuuggggaagagaaucucugcaagguaaucgauauggacgauuguuucgucuccaggcaugugaaggugugcauaauuggcaccgucucuaaauuuagccaaggagacacgcugcuuuucuuuggcccuuuggaagggggaggucugaucuacaagcacugguguacaaguaccugccaguucggcgauccaggggacauuaugucaccccgggauaaaggacuccuguguccugaguuucccggcagcuuccgcaagaaaugcaacuucgcaacuacaccaguuugugaguaugacgguaauauggugaguggguacaagaaaguaauggccaccaucgauucuuuucaguccauaaacacuagcaccaugcauuucacagacgaaagaaucgaguggaaggauccugacggcauguuaagggaucacauuaauauccuggugacgaaggacauugacuuugauaaccuuggagaaaaucccugcaaaaucggcuugcagaccucgucaauagagggggcuuggggaucuggcgucgguuucacucucacaugucugauuagucuaaccgagugcccaacauuucugacuuccaucaaggccugcgacaaagcaaucuguuauggggcugaaagcgugacccucacgcguggacaaaacacaguuaaggugucuggcaaagguggccacagcggguccaccuucaagugcugucauggagaggauugcucacagaguggccugcacgccgcggccccgcaucuugacaaggucaaugggauuagcgaaauggagaacucuaaaguguacgaugacggagcuccucaguguggcaucaagugcugguuuguuaaauccggugaauggauuucagggauauucaguggaaacuggaucguguugauuguccuguguguauuuuuacucuucagccuggugcuucuguccaucuugugccccguucggaagcacaaaaagucuuga

SEQ ID NO: 10100 - RNA, 3408 nt, Artificial Sequence
  derived and/or modified CDS sequence (opt3) from HTNV(CGAa4P15)__EF990928.1__GP
auggagaucuggaaguggcuggugauggccagccucgucuggcccgcucuugcacugagaaacguuuacgacaugaaaauugaaugcccucacaccguguccuucggcgaaaauucuguauugggguauguggaguuaccaccgaugccccuggccgauacaauacagauggucccugagucaaguuguagcauggacaaccaucaauccaugucuacugcgacgaaguacacccaggugucguggaggggaaaagcugaucaggcccagucaagccaaacaaguuuugaaacuguuuccguggaggucgaccuaaaggguaccugcgugcucaaacacaagaugguagagaagucuuaucggagccgcaaaucccugacauguuacgaucuuucaugcaauaguaccuauuguaagccaacucuguacaugaucguucccauucaugcaugcaacaugaugaaaagcuguaucauugccuugggcccuuaucgagugcaggucguguacgaacguacauacugcaugaccggggugcuccuggagggaaaguguuucgucccagaccagucuguuguguccaucguaaaacacucaauauuugauaucgcuagcgugcauauugcaugcuucuuugucgccaucacgggcaauacuuauaagcuguucgaacaggugaagaccaguuuugguacaacuuguaacgacaccgaggauaaaguucaaggguacuauauuugcauccucggaggcaauucucccccuauauacgugccaacauuagacgauuucagauccauggaggcuuuuagcggcauuuucaggucgccgcacggggaagaccacgaucuggccggagaggaaaucgcgucuuauuccauugucggucccgcaaacgccaagaucccucauucagcuaguagcgacacccuuuccuugaucgccuuuucuggcauuccaagcuacucaagucuguccauacuaacgagcucuacugaggcaaaacacguguucucacccgggcucuuuccucagcugaaucauacaaagugcgacaaaaccgcuaucccacuuacuuggacaggaauuaucgaucugcccggcuauuacgaagccguacacccguguaccguuuucugcguguugagugguccuggggcgagcugugaggccuucuccgagggaggcauauuuaacauuacgucucccaugugccucgucucgaagcagaaucgguuccgccugaccgaacagcaagugaacuuugucugucagagaguggacauggauaucguuguguacugcaauggccagaggaaaguaaucuuaacaaagacucuggucauugggcaauguaucuauaccauuacaagccucuucucccuucugccaggaguggcacacucaauagcuguugaguugugcgugccugguuuucauggcugggccacugcugcccuacuggucaccuucuguuuugggugggugcucauccccgcaauuacauucguagugcugaccguucuuaaguuuaucgccaacaucuuccacacuuccaaucaggaaaaccggcugaaaauggucuugaagaaaauuaaggaggaauuugagaaaacgaagggaucuauggugugcgacauauguaaguacgagugcgaaacauauaaagagcucaaggcucauggcgugagcugcccacagucccagugucccuacugcuucacccacugugaaccuacugagucagcguuucaagcacauuaucgcgucugccagguuacccaccgauucagagaagaucugaaaaagacagugaccccacagaacuucacuccggguuguuacaggacauuaaaucuguuucgguauaaaagccguugcuacaucuucacgauguggauuuuucuacucgugcuggagucuauccuuugggccgcuuccgccagugagacccccuugagcccuacuuggaacgacaaugcacacgggguaggcucuauuccaaugcauacagaucuggaacucgacuucucccugaccucaaguagcaaguacacauaucgcagaaaacuuacuaacccccuggaggaagcccaggcugucucguuucacguggagaucgaggaacaaaccauaggaguugaugugcaugccuugggccacugguucgacgggaggcucaaucugaagacguccuuucacuguuacggagcaugcaccaaguaugaguacccuuggcauacagcgaaaugucacuaugaacgggauuaccaguaugagacuucuugggguugcaacccaagcgacugucccggcgucgggaccggaugcacagcuugcggcuuauaccuggaccagcuaaagccgguggguucagccuacaaaaucauuacuauccgauauagucgcagaguuugugugcaguucggggaagagaaucucugcaagguaauugauauggacgauuguuuugucuccaggcaugugaaggugugcaucauaggcaccgucucuaaauucagccaaggagacacgcuguuguuuuucggcccucuugaagggggaggucugauuuuuaagcacugguguacaaguaccugccaguucggcgauccaggggacaucaugucaccccgggauaaaggauuccucuguccugaguuucccggcagcuuccgcaagaaaugcaacuuugcaacuacaccaguuugugaguacgacgguaauauggugaguggguauaagaaaguaauggccaccauugauucuuuccaguccaucaacacuagcaccaugcauuuuacagacgaaagaauagaguggaaggauccugacggcaugcugagggaucacaucaauauuuuagugacgaaggacaucgacuucgauaaccugggagaaaaucccugcaaaauuggccuucagaccucgucaaucgagggggcuuggggaucuggcgucgguuuuacuuugacaugucucauaagucugaccgagugcccaacauuccuaacuuccauuaaggccugcgacaaagcaaucuguuacggggcugaaagcgugacccugacgcguggacaaaacacaguuaaggugucuggcaaagguggccacagcggguccaccuuuaagugcugucauggagaggauugcucacagaguggccuccacgccgcggccccgcaucuggacaaggucaaugggaucagcgaaauggagaacucuaaaguguaugaugacggagcuccucaguguggcauuaagugcugguucguuaaauccggugaauggaucucagggauuuuuaguggaaacuggauagugcuuaucgucuuguguguauuccuguuauucagccucgugcugcuuuccauucugugccccguucggaagcacaaaaagucuuga

SEQ ID NO: 10101 - RNA, 3408 nt, Artificial Sequence
  derived and/or modified CDS sequence (opt3) from HTNV(CGAa75)__EU092224.1__GP
auggagaucuggaaguggcuggugauggccagccucgucuggcccgcucuugcacugagaaacguucacgacaugaaaauugaaugcccucauaccguguccuucggcaaaaauucuguaauaggguacguggaguugccaccgaugcccuuagccgauacaauccagauggucccugaaucaaguuguagcauggacaaccaccaaucccugucuacugugacgaaacauacccagguuucguggaggggaaaggcggaucaggcucagucaagccaaacaaguuuugagacuguguccgucgaaguggaccuaaaagguaccugcguacucaagcacaagcugguugaggagucuuaucggagccgcaaaucccuuacauguuacgaucugucaugcaauaguaccuauuguaagccaacuuuguacaugauugugcccauccaugccugcaacaugaugaaaagcuguauuaucgcacucggcccucaccgaguccaggugguguaugaacguacauacugcaugaccgggguccugcuggagggaaaguguuucguuccagaccagucugugguauccauagugagacacggcaucuuugauauugccucaguccauaucgcuugcuucuuuguggcaauuacggguaauacuuauaaacucuucgaacagguuaaaaagagcuuugggaccacauguaacgacacugagaauaaagugcaaggauacuacaucugcauauuaggcggcaacagucccccuauuuaugucccaacccuggaugacuucaggucuauggaggccuuuuccgggaucuucaagagcccgcacggagaagaucaugaccuugcuggugaggaaauugccucguacucuaucgugggccccgcgaaugcaaaaguaccucacuccgccucaagugauacauugagccugaucgcuuuuuccgggauuccaucuuauagcucacuaaguauacucaccuccagcacggaggccaagcacguuuucucucccggacuguuuccucagcuuaaccauacuaaaugcgacaagacagcaaucccacugaccuggacuggcauuaucgacuugcccgguuacuaugaagcugugcacccguguacagucuucugcgugcucucagggccuggagccaguugugaggcguucagcgagggcggcauauuuaauauuaccucccccaugugccuggucucuaaacagaaccgguuccgcuuaacggaacagcaagugaauuuuguuugucagagaguggauauggacaucguagucuacugcaacgggcagaggaaggugauccugaccaagacacucguuauuggacaauguaucuauacuauuaccucgcuuuucagccuguugccagguguggcccauuccauagcagucgagcuaugcgugccuggcuuucacgggugggcuacagccgcucugcucaucacuuucuguuuuggauggguacugauucccgcccuuaccuucaucgugcugacaguuuugaaauuuaucgcaaauauuuuccauaccucaaaccaggaaaaccggcucaagaugguccugaaaaagauaaaagaggaauuugagcgcacuaagggcaguauggugugcgauaucuguaaguacgagugcgaaacgaauaaagaguuaaaggcccacggugugucuugcccacagagccagugucccuacugcuucacacacugugaaccuaccgaguccgcuucacaagcgcauuaucgagucugccagguuacucacagauuuagggacgaucugaaaaagaccgugacaccacagaacuucaccccgggguguuaccggacucuaaaucucuuccguuauaaaagccgcugcuacauuuuuacaauguggaucugucugcuuguguuggaaucuauucugugggcagccuccgcuagugagaucccccucagcccuacguggaacgacaaugcccauggcguaggaucuauaccaaugcacaccgaucuggagcuugacuucucccugacuucaaguagcaaguauacauacagaaggaaguugaccaacccccucgaagagucgcaggcagucaauuuucacguggaaaucgaggagcaagccauuggcguugaugugcaugcucuggggcacugguucgacggacgguuaaaccugaaaacauccuuucauugcuauggugccuguacuaaguacgaauacccuuggcacaccgcaaaaugccauuaugagcgagauuaccaguaugaaacgucuuggggcuguaauccaagcgacugccccggggucggaaccggcugcacagcguguggucuauaccucgaccagcugaagccgguggggucagcuuauaaaaucauuacuauccgcuacaguagaaggguuugcgugcaguucggcgaggaaaaccuuuguauaguaauugauaugaaugacugcuuugucucccggcacgugaagguguguaucauuggaaccgucucuaaguucagccaaggcgauacauugcuguuuuucgggccucucgagggagguggccugaucuuaaaacacuggugcacuuccaccugucaguuuggggacccaggagauauaaugucaccccgcgacaagggcuuccugugcccugaguuucccgguagcuucagaaagaaguguaacuucgccacgacaccaguuugcgaauaugggggcaauauggugaguggauacaaaaagguaauggcaaccaucgauucuuuucaguccuucaacacuagcacaaugcauuuuaccgacgagaggauugaauggaaagauccugacggcaugcuucgugaucacaucaauauuuuggugacuaaggacaucgauuucgacaaccucggggagaaccccuguaagauaggacugcagaccucgucaauugaaggcgccugggguucuggggucggauuuacacuaacgugccugaucagucucaccgagugcccaacuuuccugacauccaucaaggcuugugacaaggccauuugcuacggcgcagagagcgugacccuuacacggggucaaaauacuguuaaagugucuggcaaagggggacauagcggcuccaccuuuaaguguugccacggggaagauuguucacagaguggauugcaugcugccgcgccgcaccuggacaaggucaacggcaucagcgagauugaaaauucuaagguguaugaugacggugccccucagugcgggauaaaauguugguucguuaaguccggagaguggaucucaggcauuuuuagugguaacuggaucguguuaauuguccucugcguauuccugcuuuuuagccugguguugcucuccauccugugucccguucgaaaacacaaggaaucuuga

SEQ ID NO: 10102 - RNA, 3408 nt, Artificial Sequence
  derived and/or modified CDS sequence (opt3) from HTNV(CGHu2)__EU363819.1__GP
augggcaucuggaaguggcuggugauggccagccucgucuggcccgcuuucgcacuuagaaacguuuacgacaugaaaauugagugcccucacaccguguccuuuggggaaaauucuguaauaggauauguggagcugccaccgaugcccuuggccgauacaacucagauggucccugaaucaaguuguagcauggacaaccaucaauccuuaaauacgaucaccaaguacacacagauuaucuggagggguaaagcggaucagucucagucgucacaaaacagcuucgagacugugaguaccggcguugaccugaaggggacaugcgugcuaaaacacaagaugauugaagaguccuaucggucucgcaagagcaucaccuguuacgaucucuccugcaauucaacuuauuguaaaccaacacuguacaugauaguccccauccaugcuugcaacaugaugaagaguugucuuauugcccugggaccuuaucgagugcagguaguuuacgagcguaccuacugcaugacgggcguguugaucgaagguaaauguuuugucccagaccagagcguggugucuauuaucaagcacgggauauucgauauugcauccguccauaucguuugcuuuuauguggccguaaaaggaaauacuuacaagauuuucgaacaggugaagaaaucauuugagagcaacuguaaugacaccgagaacaagguccaaggcuauuacaucugcaucauuggcgggaauaguucucccguguauguuccuacacucgaugacuucagauccauggaggcuuuuagcggaauaaucaggucgccacacggugaagaucacgaccuggcaggcgaggaaguggccucuuacuccauugucgggccggcuaacgccaaagugccccauucagcgaguagcgauacucugggacucaucgcauauuccggcauaccuucuuacagcucauuaaguauucugaccuccagcacagaggccaagcacguauucucuccaggucuuuuuccccaguugaaucauaccaaaugcgacaagacggcuaucccucugacuuggacagggaugaucgaccuaccaggauacuaugaagccauucaccccuguaccguuaucugcgugcucucaggcccgggcgcaaguugugaggcucugagcgaagggggaauuuucaacauaacuuccccuaugugccuugucucuaaacagaaucgguuucgccugacagagcagcaagugaacuucgucugucagagaguggauguugacaucauuguguacugcaacggucagaggaagguaaucuugaccaagacgcucgucaucggccaauguauuuauaccauaacaucgcuguucagcuuacugcccgggguggcccacuccaucgcgguugagcucugcgugccaggauuucauggcugggccacugcagcccuucuggucaccuucuguuuugguuggguguugauuccugcuaucacauucauuauccuaacuauacugaaauuuaucgcuaauauuuuccacaccucaaaccaggaaaaucggcucaagaguguacugcgcaaaaucaaggaggaauuugagcgaacaaaagggucuauggugugcgauauuuguaaguacgagugcgaaaccuauaaggagcuuaaagcccauggcguuagcugcccccagucccaguguccauacugcuucacucacugugaacccacggaggcagccuuucaagcucauuauagagucugccaggugacacacagguuccgggacgaucugaagaaaaccgugacuccucagaacuuuaccccaggauguuaccguacauugaaucucuuccgcuacaagucaagaugcuauaucuuuaccauguggauaugucuguuaguccuggaaagcauucuaugggcggcaucugccuccgagaucccgcucaaccccguuuggaaugacaacgcucacggcguggggaguauuccuaugcauacugaucuggagcuugacuucagcuugacaucuuccucaaaacacacguacaggcggaagcugaccaauccacucgaagagagucaggccaucgaucugcauguggaaauagaggagcaaacuaucggaguagacguccacgcacuuggucacugguucgauggccgacugaacuugaagaccagcuuucauugcuauggggccuguacaaaauacgaauaucccuggcacacagcuaagugccauuacgagcgcgacuaucaguacgaaacuucguggggauguaauccuuccgacugcccaggcguggguaccgggugcacggccuguggccucuaccuggaucaguuaaaacccguuggaucugcauauaagauuaucaccauuagauacagcaggcgggugugcguccaguucggcgaggaaaaccuguguaaagugaucgacaugaaugauugcuuuguuucacgccacgugaagguauguauaauugggacagucaguaaguucucccaaggagacacucuacucuuuuucgguccgcuggagggcgggggacuuaucuuuaaacauuggugcaccucuacaugucaguucggcgauccuggugacaucaugagcccaagagauaagggguuuuugugccccgaguucccuggcuccuuuaggaaaaaguguaacuucgcgacuacccccgugugcggauaugacggcaauauggugucaggguacaaaaaggucauggcuacgauugauagcuuucagaguuucaacacaucuaccaugcacuucacugacgaacguaucgaguggaaagauccagacggaaugcugcgggaucacauuaacauacucguuacaaaggacaucgacuuugauaaucugggcgaaaacccuuguaagauugguuuacagaccuccagcaucgagggggccuggggaucgggcguggguuucacucugaccugccuuauuucauugacagaaugccccacguuucucaccucuaucaaagcaugugacaaggccauaugcuauggcgcugagaguguaacucugacacgagggcaaaauaccgugaaagucuccggaaagggcgggcauagcggaucuacauucaaauguugccacggcgaggauuguagccaguccggucuacaugccgcagcuccacaccuggacaaggugaacgggaucucagaaauugagaauaguaagguuuacgaugacggagccccgcagugcggcaucaaauguugguuugucaagagcggugaauggauuucuggcaucuucuccgggaacuggauagugcucauugugcugugcguuuuucuuuuguucucacugguguuacucaguauccuguguccugucagaaaacauaagaaaagcuga

SEQ ID NO: 10103 - RNA, 3408 nt, Artificial Sequence
  derived and/or modified CDS sequence (opt3) from HTNV(CGHu3)__EU363818.1__GP
auggagaucuggaaguggcuggugauggccagccucgucuggcccgcucuugcacugagaaacguucacgacaugaaaauugaaugcccucauaccguguccuucggcaaaaauucuguaauaggguacguggaguugccaccgaugcccuuagccgauacaauccagauggucccugaaucaaguuguagcauggacaaccaccaaucccugucuacugcgacgaaauauacccaggugucguggaggggaaaggcugaucaggcccagucaagccaaacaaguuuugagacuguuuccguggaagucgaccuaaaagguaccugcgugcucaagcauaagcugguagaggagucuuaccggagccgcaaaucccuuacauguuaugaucugucaugcaauaguaccuacuguaagccaacuuuguauaugauuguucccauccacgcaugcaacaugaugaaaagcuguauuaucgcccucggcccucaucgagugcaggucguguacgaacguacauauugcaugaccggggugcugcuggagggaaaguguuucgucccagaccagucuguuguguccauaguaagacacggcaucuuugauauugcuucagugcacaucgcaugcuucuuugucgccauuacggguaauacuuacaaacucuucgaacaggugaagaaguccuuugggaccacauguaacgacacugagaauaaaguucaaggauacuauaucugcauauuaggcggcaacagucccccuauuuacgugccaacccuggaugacuucaggucuauggaggcuuuuuccgggaucuucaagagcccgcauggagaagaucacgaccuugccggugaggaaauugcgucguauucuaucgucggccccgcaaaugccaaagugccucauuccgcuucaagugauacauugagccugaucgccuuuuccgggauuccaucuuacagcucacuaaguauacucaccuccagcacggaggcaaagcacguauucucucccggacuguuuccucagcuuaaccacacuaaaugcgacaagacagcuaucccacugaccuggacuggcauuaucgacuugcccgguuauuacgaagccguucauccguguacaguguucugcguccucucagggccuggagcgaguugugaggccuucagcgagggcggcauauuuaauauuaccucccccaugugccuggugucuaaacagaaccgguuccgcuuaacggaacagcaagucaauuuugugugucagagaguugauauggacaucgugguauauugcaacgggcagaggaaggucauccugaccaagacacucgugauuggacaauguaucuacacucuuaccucgcuguucagcuugcuaccagguguugcacacuccauugcuguggagcugugcgucccuggcuuucaugggugggccacagcugcccuccugauaacuuucuguuuuggaugggugcuuauccccgcacugaccuucauuguauugacagugcucaaauuuaucgccaauaucuuccacaccucaaaccaggaaaaccggcugaagaugguuuuaaagaagauuaaagaggaauuugagcgcacuaagggcaguauggucugcgauauauguaaguacgagugcgaaacguauaaagagcugaaggcucauggugugucuugcccacagagccagugucccuacugcuucacacacugugaaccuaccgaguccgcguuucaagcacacuaucgagugugccaggucacucauagauucagggacgaucugaaaaagaccguuacaccacagaauuucaccccgggguguuaccggacucucaaccuguuucguuauaaaucacgcugcuacaucuucacaauguggauuugucuuuuggugcuggaaagcauccucugggccgcuucugccuccgagauuccccugaguccuacguggaaugacaacgcacacggcgugggaagcaucccaaugcauaccgaucuugagcuggacuuuucuuugacuuccucaaguaaguauacauacagaaggaagcucaccaauccccuggaagagagccaggccguaaacuuccacgucgaaauagaggagcaagcuaucggcguggauguucacgccuuagggcauugguuugacggacggcugaaucuaaaaacaucguuccacugcuacggugcauguacuaaguaugaauacccuuggcauaccgcgaaaugccacuaugagcgagauuaccaguaugaaacguccuggggcuguaacccaucugacugccccggggugggaaccggcugcacagcuuguggucucuaccuggaccagcuuaagccggucgggagcgccuauaaaauuaucacuauucgcuacucaagaagggugugcguucaguuuggcgaggaaaauuuguguaaggugaucgauaugaacgacugcuucguaagucggcaugucaagguguguauaauuggaaccguguccaaauuuucucaaggcgauacacuacucuucuuugggccucuggagggagguggcuuaaucuucaagcacuggugcacuagcaccugucaguuuggggacccaggagauauuaugagcccccgcgacaaaggcuuccugugcccugaguuccccgguucauuuagaaagaaauguaauuucgcaacgacaccagucugcgaauacgaugggaacaugguuagcggcuauaagaaagugauggccaccaucgacaguuuucagucuuucaauacuuccacaaugcacuuuaccgaugagaggauagaauggaaggacccugauggaaugcuucgugaccauaucaacauuuugguaacuaaggauaucgacuucgacaaucucggcgagaaccccuguaaaguggggcugcggaccagcucgauugaaggagcuuggggcucaggugucggguuuacacuaacgugccugaucucucucaccgagugcccaacuuuccugacaaguauaaaggccugugauaaagcaauuugcuacggagcugaguccgugacccuuacacgaggccagaacacuguuaaggugagcgguaaaggcgggcacucuggaagcaccuuuaaguguugccauggcgaagacuguucccaaucaggguugcacgccgcggccccgcaucuggauaaggucaauggaaucagugagaucgaaaacagcaaaguguaugacgauggcgcuccucagugcgguauuaaguguugguucguuaaaucuggggaguggaucuccggaauauuuucaggcaauuggauuguguuaaucguccucugcguauuccugcuuuucagucugguguugcucagcauucugugucccguuagaaagcacaaaaaguccuga

SEQ ID NO: 10104 - RNA, 3408 nt, Artificial Sequence
  derived and/or modified CDS sequence (opt3) from HTNV(CGHu3612)__EF990923.1__GP
augggcaucuggaaguggcuggugauggccagccucgucuggcccgcuuucgcacuuagaaaccuguacgacaugaaaauugagugcccucacaccguuuccuuuggggaaaauucugugacaggauauguagaguugccaccgaugcccuuagccgauacuacgcagauggugccugaaucaaguuguagcauggacaaccaucaaucccugaauaccauaacaaaguacacucagaucauuuggagggguaaagcggaucagucucagucgucacaaaacagcuucgagaccgucaguacagaaguggaccuaaaggggaccugcguucucaaacacaagaugaucgaggaguccuaucggucucgcaagagcauuacuuguuacgaucuguccugcaauucaacauauuguaaaccaacccuuuacaugaucgugcccauacaugcuugcaacaugaugaagaguugucugaucgccuugggcccuuaucgaguccaggugguauacgaacguacguacugcaugacuggaguucucauugagggcaaauguuuugugccagaccagagcgucgugucuaucauuaagcacgguaucuucgauauagcauccgugcauauugucugcuuuaucguugccgugaaagggaauaccuauaagauuuucgaacagguaaagaaaacauuugagucaaacuguaaugacacugagaacaaggugcaaggauacuauaucugcaucauuggcggcaauagcagucccgucuacgugccuacccuggaugacuucagaucuauggaagcauuuuccgggauaaucaggagcccacacggagaggaucacgaccuggcuggugaagagguugccucguauucuauugugggcccggcuaacgccaaagucccccauuccgcgucaagugauacacucggguuaaucgcauacagcuccauaccuucuuauagcucacugaguauucuuaccuccagcacggaagccaagcacguguucucuccaggauuguuucggcagcugaaucauacuaaaugcgacaagacagcuaucccccuaaccuggacuggcaugaucgaccucccugguuacuacgaggccauucacccauguacaguauucugcguucugucagggcccggagcaaguugugaggcuuuuagcgaaggcggcaucuucaacauugccuccccgaugugccuugugucuaaacagaaucgcuucagacugaccgagcagcaagucaacuuugugugucagagggucgauguggacauaaucguuuauugcaacgggcagcggaaggugauuuugacgaagacccucguaaucggacaauguaucuacacaauuacuucgcuguucagcuuacugccuggugucgcgcacuccauagccguggaacucugcguucccggcuuucaugggugggcaaccgcugcccuucuggugacauucuguuuuggaugggucuugaucccagcuauuacuuucaucauucuaaccauccugaaauuuauagccaauaucuuccacacaucaaaccaggagaaucgccucaagagugugcugcgaaaaauuaaggaagaguuugagagaaccaaaggcucuaugguaugcgauaucuguaaguaugaaugcgagacuuacaaggaacuuaaagcacauggugugagcugcccucagucccagugucccuauugcuucacgcacugugagccaacagaagccgcuuuucaagcgcauuacaagguuugccaggucacccacagguuccgggacgaucugaaaaagacugugacuccccagaacuuuacaccuggguguuaucguaccuugaaucucuuccgcuacaaaucaagaugcuacauuuucacuauguggguguuucuguuaguccuggagagcauccuaugggcagccucugcuuccgagauaccacucaacccgguuuggaaugacaacgcccacggcgugggaaguauucccaugcauacagaucuggaacuugacuucagcuugacgucuuccucaaaguauaccuacaggcggaagcugacuaauccucucgaggaaagucaggcaaucgaucugcacguggagauugaggaacaaacaaucggcguagacguccaugcccuugggcacugguuugauggacgacugaacuugaaaaccagcuuccacuguuauggugcuugcacaaaguacgaguauccauggcauacugccaaaugucacuacgaacgcgacuaucaguacgagaccucguggggcugcaaucccuccgacuguccuggggugggaacgggcugcaccgcaugcggucucuaccuggaucaguuaaagccaguugggucugcguauaaaauaaucacaauuagauacagcaggcggguguguguccaguuuggcgaagagaaccugugcaagaucauugacaugaaugauuguuucgugucacgccauguuaaggugugcaucauaggaacuguaaguaaauuuucccaaggcgacacccuacucuucuuugggccccuggagggagguggccuuauuuucaagcacugguguacaucuacuugccaguuuggggauccgggagacaucaugagcccuagagauaaaggcuucuuguguccagaauuucccgguuccuucaggaagaaaugcaacuucgcuaccacgccugucugugaguaugacgggaauauggugucaggcuacaagaaagugauggccacaaucgauagcauucagaguuuuaacaccucuacuaugcauuucacagacgaacguaucgaguggaaggaucccgacggaaugcugcgggaucacauuaacauacucgucaccaaggacaucgacuuugauaaucugggcgaaaacccaugcaaaauuggguuacagacuuccagcaucgagggagcauggggcucggguguuggguucacccugacaugucuuauuucauugacggagugcucuaccuuucucaccaguaucaaggccugcgacaaagcuauauguuauggagccgaauccgugacacugacccgaggccaaaauacaguaaaggugagcgguaaaggcgggcacucuggaagcuccuucaagugcugucauggcgaggaaugcucacagaucgggcuacacgcagcugccccucaucuggauaaggucaacggaauuagugagauggaaaauagcaaaguguuugacgauggcgcgccccagugugguaucaagugcugguucguuaaaucuggggaguggauuuccggaaucuuuucaggcaacuggauagugcucauuguccuguguguguuccuuuuguuuagucugguuuuacucagcauccugugcccagugagaaagcacaaaaaguccuga

SEQ ID NO: 10105 - RNA, 3408 nt, Artificial Sequence
  derived and/or modified CDS sequence (opt3) from HTNV(CGHu3614)__EF990922.1__GP
augggcaucuggaaguggcuggugauggccagccucgucuggcccgcuuucgcacuuagaaaccuguacgacaugaaaauugagugcccucacaccguuuccuuuggggaaaauucugugacaggauauguagaguugccaccgaugcccuuagccgauacuacgcagauggugccugaaucaaguuguagcauggacaaccaucaaucccugaauaccauaacaaaguacacucagaucauuuggagggguaaagcggaucagucucagucgucacaaaacagcuucgagaccgucaguacagaaguggaccuaaagggcacuugcguucucaaacacaagaugaucgaggaguccuaucggucucgcaagagcauuacuuguuacgaucuguccugcaauucaacauauuguaaaccaacccuuuacaugaucgugcccauacaugcuugcaacaugaugaagaguugucugaucgccuuggggccuuaucgaguccaggugguauacgaacguacguacugcaugacuggaguucucauugagggcaaauguuuugugccagaccagagcgucgugucuaucauuaagcacgguaucuucgauauagcauccgugcauauugucugcuuuuucguugccgugaaagggaauaccuauaagaucuuugaacagguaaagaaaacauucgagucaaacuguaaugacacugagaacaaggugcaaggauacuauauuugcaucaucggcggcaauagcagucccgucuacgugccuacccuggaugacuuuagaucuauggaggcuuucuccgggauuuuuaggagcccacacggagaagaucacgaccuggccggugaagagguugccucguauucuauagugggcccggcuaacgccaaagucccccauuccgcgucaagugauacacucggguuaaucgcauacagcuccauuccuucuuauagcucacugaguauccuuaccuccagcacggaagccaagcacguguucucuccaggauuguuuccccagcugaaucauacuaaaugcgacaagacagcuauaccucuaaccuggacuggcaugauugaccucccagguuacuacgaggccauccaccccuguacaguauucugcguucugucagggccgggagcaaguugugaggcuuucagcgaaggcggcaucuuuaacauugccuccccuaugugccuugugucuaaacagaaucgguuccgccugaccgagcagcaagucaacuuugugugucagagagucgauguggacaucauuguuuauugcaacgggcagaggaaggugauauugacgaagacccucguaaucggacaauguauuuacacaaucacuucgcuguucagcuuacugcccggugucgcgcacuccaucgccguggaacucugcguuccaggcuuucaugggugggcaaccgcugcccuucuggugacauucuguuuuggaugggucuugauuccugcuauaacuuucaucauucuaaccauccugaaauuuauugccaauaucuuccacacaucaaaccaggagaaucggcucaagagugugcugcgcaaaauaaaggaagaguuugagcgaaccaaaggcucuaugguaugcgauaucuguaaguaugaaugcgagacuuacaaggaacuuaaagcacauggugugagcugcccccagucccaguguccauauugcuucacgcacugugagcccacagaagccgcuuuucaagcgcauuacaagguuugccaggucacccacagauucagggacgaucugaaaaagacugugaccccucagaacuucacaccaggguguuaucggaccuugaaucucuuucguuacaaaucacgcugcuacauuuucacuauguggguguuucuguuaguccuggagagcauccuaugggcagccucugcuuccgagauuccgcucaaccccguuuggaaugacaacgcccacggcgugggaaguaucccuaugcauacagaucuggaacuugacuucagcuugacgucuuccucaaaguauaccuacagaaggaagcugacuaauccacucgaggaaagucaggcaauagaucugcacguggagauugaggaacaaacaaucggcguagacguccaugcccuugggcacugguuugauggacggcugaacuugaaaaccagcuuccacuguuauggugcuugcacaaaguacgaguaucccuggcauacugccaaaugucacuacgaacgagacuaucaguacgagaccucguggggcugcaauccuuccgacuguccaggggugggaacgggcugcaccgcaugcggucucuaccuggaucaguuaaagcccguugggucugcguauaaaauuaucacaauacgcuacagcagaaggguguguguccaguuuggcgaagagaaccugugcaagaucauugacaugaaugauuguuucgugucacggcauguuaaggugugcaucauuggaacuguaaguaaauuuucccaaggcgacacccuacucuucuuugggccgcuggagggagguggccuuaucuucaagcacugguguacaucuacuugccaguuuggggauccuggagacauaaugagcccacgcgauaaaggcuucuugugucccgaguucccugguuccuuuagaaagaaaugcaacuucgcuaccacgcccgucugugaauaugacgggaauauggugucaggcuacaagaaagugauggccacaauugauagcuuucagaguuucaacaccucuacuaugcauuuuacagacgaaaggaucgaguggaaggauccagacggaaugcugcgugaucacaucaacauucucgucaccaaggacaucgacuucgauaaucugggcgaaaacccuugcaaaauuggguuacagacuuccagcauagagggagcauggggcucggguguuggguuuacccugacaugucuuaucucauugacggagugcucuaccuuccucaccaguauuaaggccugcgacaaagcuaucuguuauggagccgaauccgugacacugacccggggccaaaauacaguaaaggugagcgguaaaggcgggcacucuggaagcuccuuuaagugcugucauggcgaggaaugcucacagauugggcuacacgcagcugcaccccaucuggauaaggucaacggaaucagugagauggaaaauagcaaaguguucgacgauggcgcgccacagugugguauaaagugcugguuuguuaaaucuggggaguggaucuccggaauuuucucaggcaacuggaucgugcucauuguccuguguguguuccuuuuguuuagucugguuuuacucagcauccugugcccggugcgaaagcacaaaaaguccuga

SEQ ID NO: 10106 - RNA, 3408 nt, Artificial Sequence
  derived and/or modified CDS sequence (opt3) from HTNV(CGRn15)__EU363814.1__GP
auggagaucuggaaguggcuggugauggccagccucgucuggcccgcucuugcacugagaaacguucacgacaugaaaauugaaugcccucauaccguguccuucggcaaaaauucuguaauaggguacguggaguugccaccgaugcccuuagccgauacaauccagauggucccugaaucaaguuguagcauggacaaccaccaaucccugucuacugugacgaaguauacccagguuucguggaggggaaaggcggaucaggcucagucaagccaaacaaguuccgagacugugucugucgaaguggaccuaaaagguaccugcguacucaagcauaagcugguugaggagagcuaccggucccgcaaaucacuuacauguuaugaucugaguugcaauagcaccuacuguaagccaacuuuguauaugauugugcccauccacgccugcaacaugaugaaaucuuguauuaucgcacucggcccucaucgaguccaggugguguacgaacguacauauugcaugaccgggguccugcuggagggaaaguguuuuguuccagaccaguccgugguaucaauagugagacacggcaucuucgauauugccagcguccacaucgcuugcuuuuucguggcaauuacggguaauacuuacaaacucuuugaacagguuaagaagaguuucgggaccacauguaacgacacugagaauaaagugcaaggauacuauaucugcauauuaggcggcaacucucccccuauuuacgucccaacccuggaugacuuuagguccauggaggccuucagcgggaucuuuaagucgccgcauggagaagaucacgaccuugcuggugaggaaauugccucuuauuccaucgugggccccgcgaaugcaaaaguaccucauucagccaguagcgauacauugucccugaucgcuuucucugggauuccaagcuacucaagucuauccauacucaccagcucuacggaggccaagcacguuuucucacccggacuguucccucagcuuaaccacacuaaaugcgacaagacagcaaucccacugaccuggacuggcauuaucgacuugcccgguuauuacgaagcugugcauccguguacagucuuuugcgugcucagugggccuggagccagcugugaggcguucuccgagggcggcauauucaauauuaccucucccaugugccuggucucgaaacagaaccgguuucgcuuaacggaacagcaagugaauuucguuugucagagaguggauauggacaucguagucuauugcaacgggcagaggaaggugauccugaccaagacacucguuauuggacaauguaucuacacuauuaccagccuguuuucccuuuugccagguguggcccacucaauagcagucgagcuaugcgugccuggcuuccaugggugggcuacagccgcucugcucaucacuuuuuguuucggauggguacugauucccgcccuuaccuuuaucgugcugacaguuuugaaauucaucgcaaauauuuuucacaccaguaaccaggaaaaccggcucaagaugguccugaaaaagauaaaagaggaauuugagcgcacuaagggcucuauggugugcgauaucuguaaguacgagugcgaaacguauaaagaguuaaaggcccauggugugagcugcccacagucccagugucccuacugcuuuacacacugugaaccuaccgagucagcuuuccaagcgcacuaucgagucugccagguuacucauagauuuagggacgaucugaaaaagaccgugacaccacagaauuucaccccgggguguuaccggacucuaaaccucuuccguuauaaaagccgcugcuacauuuuuacaauguggaucugucugcuuguguuggaaucuauucugugggcagccuccgcuagugagaucccccucagcccuacguggaaugacaacgcccacggcguaggaucuauaccaaugcauaccgaucuggagcuugacuucucccugacuucaaguagcaaguauacauacagaaggaaguugaccaauccccucgaagagucgcaggcagucaacuuucacguggaaaucgaggagcaagccauuggcguugaugugcacgcucuggggcauugguucgacggacgguuaaaucugaaaacauccuuucacugcuacggugccuguacuaaguaugaauacccuuggcauaccgcaaaaugccacuaugagcgagauuaccaguaugaaacgucuuggggcagcaacccaucagacugucccggggucggaaccggcugcacagcgugcggucuauaccucgaccagcugaagccgguggggagugcuuauaaaaucauuacuauccgcuacuccagaaggguuugugugcaguucggcgaggaaaaucuuugcaagguaauagauaugaacgacuguuuugucucucggcaugugaaggugugcauuaucggaaccgucagcaaauucucccaaggcgauacauugcuguuuuucgggccucucgagggagguggccugauuuuuaagcacugguguacuucaaccugccaguucggggacccaggagauaucaugagcccccgcgacaaaggcuuuuuauguccugaguuccccgguaguuucagaaagaaaugcaauuuugccacgacaccaguuugugaauacgaugggaacauggugucuggcuauaagaaaguaauggcaaccauagacuccuuccagagcucgaauacuucaacaaugcacuuuaccgaugagaggaucgaauggaaggacccugauggaaugcugcgugaccauauuaacauccuugugacuaaggauauugacuucgacaauuugggcgagaaccccugcaaaaucgggcuccagaccucuaguauagaaggagccuggggcuccggugucggguuuacacugacgugucuaauuagccugaccgagugcccaacuuuccucacaucuaucaaggcuugcgauaaagccaucuguuacggagcagagagcgugacccugacacggggccaaaacacuguuaagguguccgguaaaggcgggcacucaggaaguaccuuuaagugcugucauggcgaagacugcagccagucugggcuucacgcugccgcgccgcauuuggauaaggucaauggaauuuccgagaucgaaaacucaaaaguguaugacgauggcgccccucagugugguguuaagugcugguucgugaaaaguggggaguggauuagcggaauauuuuccggcaauuggaucguccugauuguauuauguguguuccuccuguuuucucuuguucuguugucgauccucugccccgugcgaaagcacaaaaagagcuga

SEQ ID NO: 10107 - RNA, 3408 nt, Artificial Sequence
  derived and/or modified CDS sequence (opt3) from HTNV(CGRn2616)__EU363816.1__GP
auggagaucuggaaguggcuggugauggccagccucgucuggcccgcucuugcacugagaaacguucacgacaugaaaauugaaugcccucauaccguguccuucggcaaaaauucuguaauaggguacguggaguugccaccgaugcccuuagccgauacaauccagauggucccugaaucaaguuguagcauggacaaccaccaaucccugucuacugugacgaaacauacccagguuucguggaggggaaaggcggaucaggcucagucaagccaaacaaguuuugagacuguguccgucgaaguggaccuaaaagguaccugcguacucaagcacaagcugguugaggagucuuaucggagccgcaaaucccuuacauguuacgaucugucaugcaauaguaccuauuguaagccaacuuuguacaugauugugcccauccaugccugcaacaugaugaaaagcuguauuaucgcacucggcccucaccgaguccaggugguguaugaacguacauacugcaugaccgggguccugcuggagggaaaguguuucguuccagaccagucugugguauccauagugagacacggcaucuuugauauugccucaguccauaucgcuugcuucuuuguggcaauuacggguaauacuuauaaacucuucgaacagguuaagaaguccuuugggaccacauguaacgacacugagaauaaagugcaaggauacuacaucugcauauuaggcggcaacagucccccuauuuaugucccaacccuggaugacuucaggucuauggaggccuuuuccgggaucuucaagagcccgcacggagaagaucaugaccuugcuggugaggaaauugccucguacucuaucgugggccccgcgaaugcaaaaguaccucacuccgccucaagugauacauugagccugaucgcuuuuuccgggauuccaucuuauagcucacuaaguauacucaccuccagcacggaggccaagcacguuuucucucccggacuguuuccucagcuuaaccauacuaaaugcgacaagacagcaaucccacugaccuggacuggcauuaucgacuugcccgguuacuaugaagcugugcacccguguacagucuucugcgugcucucagggccuggagccaguugugaggcguucagcgagggcggcauauuuaauauuaccucccccaugugccuggucucuaaacagaaccgguuccgcuuaacggaacagcaagugaauuuuguuugucagagaguggauauggacaucguagucuacugcaacgggcagaggaaggugauccugaccaagacacucguuauuggacaauguaucuauacuauuaccucgcuuuucagccuguugccagguguggcccauuccauagcagucgagcuaugcgugccuggcuuucacgggugggcuacagccgcucugcucaucacuuucuguuuuggauggguacugauucccgcccuuaccuucaucgugcugacaguuuugaaauuuaucgcaaauauuuuccauaccucaaaccaggaaaaccggcucaagaugguccugaaaaagauaaaagaggaauuugagcgcacuaagggcaguauggugugcgauaucuguaaguacgagugcgaaacgaauaaagaguuaaaggcccacggugugucuugcccacagagccagugucccuacugcuucacacacugugaaccuaccgaguccgcuuuucaagcgcauuaucgagucugccagguuacucacagauucagggacgaucugaaaaagaccgugacaccacagaacuucaccccgggguguuaccggacucuaaaucucuuucguuauaaaucacgcugcuacauuuucacaauguggaucugucugcuuguguuggaaagcauucugugggcagccucugcuuccgagaucccccucaguccuacguggaacgacaaugcccauggcguaggaagcauaccaaugcacaccgaucuggagcuugacuuuucucugacuuccucaaguaaguauacauacagaaggaaguugaccaacccccucgaagagagccaggcagucaauuuccacguggaaaucgaggagcaagccauuggcguugaugugcaugcucuggggcacugguuugacggacgguuaaaccugaaaacaucguuccauugcuauggugccuguacuaaguacgaauacccuuggcacaccgcaaaaugccauuaugagcgagauuaccaguaugaaacguccuggggcuguaauccaucugacugccccggggucggaaccggcugcacagcguguggucuauaccucgaccagcugaagccgguggggagcgcuuauaaaaucauuacuauccgcuacucaagaaggguuugcgugcaguuuggcgaggaaaaccuuuguauaguaauugauaugaaugacugcuucgucagucggcacgugaagguguguaucauuggaaccgucuccaaguuuucucaaggcgauacauugcuguucuuugggccucucgagggagguggccugaucuucaaacacuggugcacuagcaccugucaguuuggggacccaggagauauaaugagcccccgcgacaagggcuucuuaugcccugaguuccccgguucauuuagaaagaaguguaacuucgccacgacaccaguuugcgaauaugggggcaauauggugagcggauacaaaaagguaauggcaaccaucgauaguuuucagucuuucaacacuuccacaaugcauuuuaccgacgagaggauugaauggaaagauccugacggcaugcugcgugaucacaucaauauucuugugacuaaggacaucgauuucgacaacuugggggagaaccccuguaagauaggacuccagaccagcucgauugaaggcgccugggguucaggggucggauuuacacugacgugccuaaucucucugaccgagugcccaacuuuccucacaaguaucaaggcuugugacaaggccauuugcuacggcgcagaguccgugacccugacacggggucaaaauacuguuaaagugagcggcaaagggggacauucuggcagcaccuuuaaauguugccacggggaagauuguucccagucaggacuucaugcugccgcgccgcacuuggacaaggucaacggcaucagugagauugaaaauagcaagguguaugaugacggugccccucagugcgggauaaaauguugguucguuaagucuggagaguggaucuccggcaucuuuucagguaacuggauugugcugauugucuuaugcguauuccuccuguucagucuugugcuguugagcauccucugucccguucgaaaacacaagaaauccuga

SEQ ID NO: 10108 - RNA, 3408 nt, Artificial Sequence
  derived and/or modified CDS sequence (opt3) from HTNV(CGRn2618)__EU363817.1__GP
auggagaucuggaaguggcuggugauggccagccucgucuggcccgcucuugcacugagaaacguucacgacaugaaaauugaaugcccucauaccguguccuucggcaagaauagcguaauaggguacguggaguugccaccgaugcccuuagccgauacaauccagauggucccugaaucaaguuguagcauggacaaccaccaaucccugucuacugugacgaaauauacccagguuucguggaggggaaaggcggaucaggcucagucaagccaaacaccauuugagacugugagugucgaaguggaccuaaaacggaccugcguacucaagcauaagcugguugaggaguccuaccgcucucgaaaaagccuuacauguuaugaucuguccugcaauucaaccuacuguaagcccacuuuguauaugauugugccuauccacgccugcaacaugaugaaaaguuguauuaucgcacucgguccacaucguguccaggugguguacgaaagaacauauugcaugaccggcguccugcuggaggggaaguguuucguucccgaccagagcgugguaucuauagugaggcacggaaucuuugauauugccuccguccacaucgcuugcuucuuuguggcaauuacgggcaauacuuacaaacucuucgaacagguuaagaagucauuugguaccacauguaacgacacugagaauaaagugcaaggguacuauaucugcauauuaggaggcaacagcccuccaauuuacgucccgacccuggaugacuuccggaguauggaggccuuuucuggcaucuucaagaguccccauggggaagaucacgaccuugcuggagaggaaauugccagcuauucgaucguggguccugcgaaugcaaaaguaccacauucugccuccucagauacauugagucugaucgcuuuuagcggcauucccuccuacucuagccuaucaauacucaccaguuccacggaggccaagcacguuuucagcccugggcuguuuccacagcuuaaccacacuaaaugcgacaagacagcaaucccccugaccuggacuggaauuaucgacuugccgggcuauuacgaagcugugcauccuuguacagucuucugcgugcucucuggucccggggccucaugugaggcguucagugagggaggcauauuuaauauuaccagcccaaugugccuggucuccaaacagaaccgcuucagauuaacggaacagcaagugaauuuuguuugucagaggguggauauggacaucguagucuauugcaacggccagcggaaggugauccugaccaagacacucguuauugggcaauguaucuacacuauuaccucucuuuucucgcuguugccuggaguggcccacagcauagcagucgagcuaugcgugcccgguuuucauggcugggcuacagccgcucugcucaucacuuucuguuuuggguggguacugauuccagcccuuaccuucaucgugcugacaguuuugaaauuuaucgcaaauauuuuccacaccuccaaccaggaaaaccgccucaagaugguccugaaaaagauaaaagaggaauuugagcgaacuaagggaucaauggugugcgauaucuguaaguacgagugcgaaacguauaaagaguuaaaggcccauggcgugaguugcccccagucucaguguccuuacugcuucacacacugugaaccaaccgagagcgcuuuucaagcgcacuauagagucugccagguuacucauagguuccgggacgaucugaaaaagaccgugacaccgcagaauuucacccccgguuguuaccguacucuaaaccucuuucgcuauaaauccagaugcuacauucugacaauguggaaucuuuugcugaucccuggguauaggcucugggcagccucagcuagcgaaauuccacugucucccacguggaacgacaaugcccacggcgugggauccaucccuaugcauaccgaucuugagcuggacuucaguuugacuucuucuuccaaguacacauaccggcgaaagcucaccaacccacuggaggaaucacaggcaguaaauuuucacgucgagauagaggagcaagccaucggcguggauguucacgcuuuagggcauugguucgacggacgccugaaccuaaaaacaaguuuucacuguuauggugccugcacuaaguacgaguaucccuggcauaccgcaaaaugucacuacgaaagagauuaucaguacgagacgagcuggggcugcaauccgucggacuguccuggggugggaaccggcugcacagcgugcggucucuaucuggaccagcuuaagccagucggguccgcuuacaaaauuaucacuauuagguacucucggcgcguguguguucaguucggcgaagagaacuugugcaucgugauagauaugaaugacuguuuuguaagcagacaugucaaggugugcauuaucggaaccgugucaaaguucagucaaggcgauacacugcucuuuuucgggccccuggaaggagguggcuuaauuuuuaaacacugguguacuucuaccugccaguucggggacccuggagauaucaugucccccagggacaagggcuuucuguguccagaguucccugguagcuuccguaaaaagugcaacuuugccacgacacccgucugugaguaugggggcaauaugguuuccggauacaaaaaggugauggcaaccauagauucauuccagagcuuuaacacuuccacaaugcacuucaccgacgaacggaucgaguggaaagauccagacggcaugcuucgagaucauauuaauaucuugguaacuaaggacauugauuuugacaaccucggggaaaacccgugcaagaucggacugcagaccucuuccauagagggcgccugggguagcggggugggauucacacuaacgugucugauuucgcucaccgaaugcccuacuuuucugacaucaaucaaggcuugcgacaaggccaucuguuauggcgcagagucugucacccuuacaagaggucaaaauacugugaaaguuaguggcaaagggggacacuccggcagcaccuucaaaugcugucauggggaggauugcucucagagcggauugcacgcugccgcgccccaucuggacaaggugaacggcauuuccgaaaucgaaaauucaaaggucuacgaugacggugccccacagugugggauuaaaugcugguuugugaagaguggagaauggauaagcggcaucuucucugguaacuggauuguuuuaaucgugcucugugucuuucugcuuuucucccugguauugcucucaauucugugccccgugaggaaacacaagaaaaguuga

SEQ ID NO: 10109 - RNA, 3408 nt, Artificial Sequence
  derived and/or modified CDS sequence (opt3) from HTNV(CGRn45)__EU092225.1__GP
auggagaucuggaaguggcuggugauggccagccucgucuggcccgcucuugcacugagaaacguucacgacaugaaaauugaaugcccucauaccguguccuucggcaagaauaguguaauaggguacguggaguugccaccgaugcccuuagccgauacaauccagauggucccugaaucaaguuguagcauggacaaccaccaaucccugucuacugugacgaaauauacccagguuucguggaggggaaaggcggaucaggcucagucaagccaaacaaguuuugaggccguguccgucgaaguggaccuaaaagguacuugcguacucaagcauaagcugguugaggagucuuaccggagccgcaaaucccuuaccuguuaugaucugucaugcaauaguacauacuguaagccaaccuuguauaugauugugcccauccacgcaugcaacaugaugaaaagcuguauuaucgcccucggcccucaucgaguccaggugguguacgaacguacuuauugcaugacagggguccugcuggagggaaaguguuucguuccagaccagucugugguauccauagugagacacggcaucuuugauauugcuucaguccacaucgcaugcuucuuuguggccauuaccgguaauacguacaaacucuucgaacagguuaaaaagagcuuugggacuaccuguaacgacacagagaauaaggugcaaggauacuauaucugcauauuaggcggcaacagucccccuauuuacgucccaacucuggaugacuucaggucuauggaggcuuuuuccgggaucuucaagagcccgcauggagaagaucacgaccuugccggugaggaaauugcgucguauucuaucgugggccccgcaaaugccaaaguaccucauuccgcuucaagugauaccuugagccugaucgccuuuuccgggauuccaucuuacagcucacuaaguauacucacauccagcaccgaggcaaagcacguuuucucucccggacuguuuccucagcuuaaccacacgaaaugcgacaagacugcuaucccacugacauggaccggcauuaucgacuugcccgguuauuacgaagccgugcauccguguacugucuucugcgugcucucagggccuggagcgaguugugaggccuucagcgagggcggcauauuuaauauuacaucccccaugugccuggucucuaaacagaaccgguuccgcuuaaccgaacagcaagugaauuuuguuugucagagaguggauauggacaucguagucuauugcaacgggcagaggaaggugauccugacgaagacccucguuauuggacaauguaucuacacaauuacuucgcuuuucagccuguugccagguguggcacacuccauagcugucgagcuaugcgugccuggcuuucaugggugggccaccgcugcccugcucaucacauucuguuuuggauggguacugauucccgcacuuacuuucaucgugcugaccguuuugaaauuuaucgccaauauuuuccacacaucaaaccaggaaaaccggcucaagaugguccugaaaaagauaaaagaggaauuugagcgcaccaagggcaguauggugugcgauaucuguaaguacgagugcgaaacuuauaaagaguuaaaggcucauggugugucuugcccacagagccagugucccuacugcuucacgcacugugaaccuacagaguccgcguuucaagcacacuaucgagucugccagguuacccauagauucagggacgaucugaaaaagacugugaccccacagaauuucacaccgggguguuaccggacccuaaaccucuuucguuauaaaucacgcugcuacauuuucacuauguggaucugucugcuuguguuggaaagcauucugugggccgcuucugccuccgagaucccccucaguccuacauggaaugacaacgcacacggcguaggaagcauaccaaugcauacggaucuggagcuugacuuuucucugaccuccucaaguaaguauacuuacagaaggaaguugacaaauccccucgaagagagccaggccgucaacuuccacguggaaaucgaggagcaagcuauuggcguugaugugcacgcccuggggcauugguuugacggacgguuaaaucugaaaaccucguuccacugcuacggugcauguacaaaguaugaauacccuuggcauacugcgaaaugccacuaugagcgagaucaucaguacgaaaccuccuggggcuguaacccaucugacugccccggggucggaacgggcugcaccgcuuguggucuauaucucgaccagcugaagccgguggggagcgccuacaaaaucauuacaauccgcuauucaagaaggguuugcgugcaguuuggcgaggaaaaucuuuguaagguaauagaucggaacgacugcuucgucagucgccacgugaagguguguauuaucggaacugucuccaaauuuucucaaggcgauaccuugcuguucuuugggccucucgagggagguggccugauuuucaagcacuggugcacaagcacuugucaguuuggggacccaggagauaucaugucccccagagacaaaggcuucuuaugcccugaguuccccgguucauuuaggaagaaauguaauuucgcaaccacgccaguuugcgaauacgaugggaacauggugagcggcuacaagaaaguaauggccacaauagacaguuuucagucuuucaauaccuccacuaugcauuuuacagaugagcguaucgaauggaaggacccugauggaaugcugcgggaccacauuaacauccuugugaccaaggauauugacuucgacaauuugggcgagaaccccuguaaaaucgggcuccagacuagcucgauagaaggagcuuggggcucaggugucggguuuacccugacaugccuaauuucucugacggagugcccaaccuuccucacuucuaucaaggccugugauaaagcaaucugcuauggagcugaguccgugacacugacccgaggccaaaacacaguuaaggugagcgguaaaggcgggcauucuggaagcacuuuuaaguguugccacggcgaagacuguucccagucagggcuucaugccgcggccccgcacuuggauaaggucaauggaauuagugagaucgaaaacagcaaaguguacgacgauggcgcuccucagugcgguauuaaguguugguucguuaaaucuggggaguggauauccggaaucuuuucaggcaauuggauugugcugaucgucuuaugcguauuccuccuguucagucuugugcuguugagcauucucugucccguuagaaagcacaaaaaguccuga

SEQ ID NO: 10110 - RNA, 3408 nt, Artificial Sequence
  derived and/or modified CDS sequence (opt3) from HTNV(CGRn53)__EF990921.1__GP
augggcaucuggaaguggcuggugauggccagccucgucuggcccgcuuacacccuuagaaacguuuaugacaugaaaauugagugcccucacacaguguccuucggggaaaauucuguaauaggauacguggagcugccaccgauccccuuggcagauacuacgcagauggucccugaaucaaguuguagcauggacaaccaucaauccuuaaauaccauuacaaaguauacucaggugucuuggagggguaaagccggccaggcgcaggcuucgcaaaacucauuugaggccguuagcgcagaaguggaucugaaggggaccugcguccuaaaacacaagaugcucgaggagaguuaccggucccgcaagucuaucgccuguuaugaccugagcugcaauuccacauacuguaaaccaacccuuuauaugauugugcccauccaugcuugcaacaugaugaagucaugucugauagcauugggaccucaccgaguacagguuguguacgaacguacuuacugcaugacaggcguccucaucgaggguaaauguuucgugccagaucagaguguggucagcauuaucaagcaugggauuuuugacaucgccucuguucacauagugugcuucuuuguagcugugaaaggaaauaccuauaagauuuucgaacagaucaagaaauccuuugagucaacguguaacgauacuaagaauaaaguccaaggcuacuauauuugcaucgugggcgggaacagcgcccccaucuacguuccuacccuggacgauuucagaaguauggaggcguuuucuggaauuuucagguccccacacggugaagaccaugaucuggcaggcgaggaaauagccagcuauucgaucguggggccggcuaaugccaaggucccccacucugcauccucagacacacucaguuuaacugcuuacagcggcauuccuuccuauucuagccugucaauccuugccggaagugcggaggccaaacauguguuuuccccagguuucuuuccccaguugaaccacaccaagugcgauaaaacagcaauaccucugauguggaccgggaugauugaccuaccaggauacuacgaagcuauccaccccuguacgguauucugcguucucagcggcccgggcgccucuugugaggcuuucucagaagggggaaucuuuaauauuacuuccccuaugugccuggugagcaagcagaaccgguuccgccuuacagaacagcaagucaauuuugugugucagagagucgacauggauaucauuguguauugcaacggucagaggaagguuauacugaccaaaacuuuggugaucggccaauguauuuacacaaucaccucccucuucucucuguuacccgggguagcccauucgaucgcagucgagcugugcgugccaggauuucacggcugggccacggcugcgcuccuuguuaccuucuguuuugguugggugcugauuccugcaaugacauucauagucuugacuauccuaaaguuuauugccaacaucuuccauaccagcaaucaggaaaacaaacugaaguccgugcuccggaaaauuaaggaggaauuugagaagacaaaagggucaaugguaugcgacguguguaaguaugagugcgaaacuuacaaagagcugaaggcucacggcguuaguugcccccagucucaguguccauauugcuucacccauugugaacccacagaggccgcauuucaagcccacuaccgcgucugccaggugacccaccgauucagagaugaccuuaaaaagacugugacgccucagaauuucacaccaggauguuauaggacccugaacuuguuucgguacaagagccguugcuacauccucacuauguggaaucuguuacuggucccgggcuaucgcgcuugggccgcauccgcgucagaaauaccccuaaacccuguuuggaaugauaacgcucauggggugggaagcgugccaaugcacaccgaccucgagcuggauuucucucuuacauccaguagcaaauacaccuauagaaggaaguugacuaauccccuggaggaaucucaggccaucaaccuccauauugagaucgaggagcaaacaauugguguagacguccacgcacugggccacugguuuguggggcggcuuaaucugaaaacguccuuccauuguuacggagccugcaccaaguaugaguacccuuggcacacugcuaaaugucauuaugaacgagauuaccaguacgagacaucauggggcugcaacccaagugacugucccgguguugggaccggcugcacagccugcggauuguaucucgaucagcugaagccggugggcagcgcauacaagaucauaacuauucgcuauucgagaagggucugugugcaguuuggggaagagaauuuaugcaaaaucauugacaugaacgacuguuucguuucccggcacgugaagguaugcaucauaggaaccgucucuaaauuuagccaaggugauacgcugcuauucuuuggcccucucgaagggggaggccugaucuucaagcauugguguaccucaacaugccaguuuggugacccaggggauauuaugaguccccgcgacaaaggcuuccuuuguccugaguuucccggauccuucagaaagaaaugcaauuucgcuacuaccccauugugugaguacgauggcaacauggugucuggguauaagaaggugauggccacaaucgacagcuuucaguccuucaacacuucaaccaugcacuuuacggaugaaaggauugaguggaaagacccugauggaaugcugcgugaccacaucaauauacucgucacaaaggauauugacuucgaaaaccugggcgagaaucccugcaaaaucgguuuacagaccagcaguaucgaaggggcguggggaucuggcguugguuuuacucugacaugucuuguguccuugaccgagugcccaacuuuccucaccagcauuaaggccugcgauaaagcuaucuguuacggcgcagagucgguaacacugacgcgggggcaaaacaccgugaaggucucaggaaagggcgggcauucuggaaguacuuuuaaaugcugucacggcgaagagugcucccagauuggucuacaugccgcugccccgcaccuggacaaggugaaugggauaagcgaaaucgagaacaauaaaguuuaugacgauggagcaccucaguguggcauuaagugcugguucgugaaaucuggugaauggaucagcggcauuuuuagugggaacuggaucguccucauagugcuguguguuuuccuuuuguuuucacugaucuuacucaguauucugugccccgugcgaaagcauaagaaaagcuga

SEQ ID NO: 10111 - RNA, 3408 nt, Artificial Sequence
  derived and/or modified CDS sequence (opt3) from HTNV(CGRn93MP8)__EF990919.1__GP
augggcaucuggaaguggcuggugaaagccagccucgucuggcccgcuuacacccuuagaaacguuuaugacaugaagauugagugcccucacacaguguccuucggggaaaauucuguaauaggauacguggagcugccaccgauccccuuggcagauacuacgcauauggucccugaaucaaguuguagcauggacaaccaccaguccuuaaauaccauuacaaaauauacucaagugucuuggagggguaaggccgaucaggcgcaggcuucgcagaacucauuugaggccguuagcgcagaaguggaccugaaagguaccugcguccuaaagcauaagaugcucgaggagaguuaccggucccgcaaaucuaucgccuguuaugaucugagcugcaauuccacauacuguaagccaacccuuuauaugauugugcccauccacgcuugcaacaugaugaaaucaugucugauagcauuggggccucaucgaguacaaguuguguacgaacguacuuacugcaugacaggauuccucaucgagggcaaguguuuugucccagacagaaguguggugagcauuaucaaacacgguauuuucgauaucgccucuguccacauaguuugcuuuuucguggcuguaaaggggaauaccuauaagauuuuugaacagaucaaaaaguccuucgagucaacguguaacgacacuaaaaauaaggugcagggauacuauauuugcaucgucggcggcaacagcgcccccaucuacgugccuacccuggaugacuuuaggaguauggaggcguucucugggauuuuucgguccccacauggagaagaucacgaccuggcaggcgaggaaauagccagcuauucgaucguuggcccggcuaaugccaaagugccccauucugcauccucagauacacucaguuuaacugcuuacagcgggauuccuuccuauucuagccugucaauccuugccggaagugcggaggccaagcacgucuucuccccaggcuuuuugccccagcugaaccacaccaaaugcgacaagacagcaauaccucuaauguggaccgguaugauugaccucccaggguacuacgaagcuauccaucccuguacgguguucugcguacugagcggaccgggcgccucuugugaggcuuucucagagggcgggaucuuuaauauuaccaguccuaugugccuuguuagcaagcaaaaccgcuucagacugacagaacaacaggugaauuuugucugucagaggguggauauggacaucauugucuauugcaacggacagcggaaagugauauugaccaagacucucguuaucggucaguguauuuacacaaucaccucccuguucucuuuacugcccggcguggcccacucgaucgcaguagagcucugcgucccaggguuucauggaugggccacggcugcgcuucuggugaccuucuguuuuggcuggguuuugauuccugcaaugacauucauagugcuaacuauccugaaauuuauugccaacaucuuccacaccagcaaucaggaaaacaagcucaaauccguccugcgcaagauuaaggaggaauuugagaaaacaaaggguucaauggugugcgauguauguaaauaugagugcgaaacuuacaaggagcuuaaagcucauggggugaguugcccccaaucucaguguccauauugcuucacccacugugaacccacagaggccgcauuucaggcccacuaccgaguuugccaggucacccauagauucagggacgaucugaagaagacugugacgccucaaaauuucacaccaggcuguuaucggaccuugaaccucuuucguuacaaaagccgcugcuacaucuucacuauguggguguuucuguuaguccuggaauccauacuaugggcugccucagcaagcgagaucccgcucaaucccguuuggaacgacaaugcgcacggagugggcucugugccuaugcauaccgaucuggagcuugacuucuccuugacaaguagcucuaaguauaccuacagaaggaaacugacuaacccacucgaagagucccaggcuauuaaucugcacaucgaaauugaggagcagacaaucgggguagauguccacgcccuuggacauugguuugacggucggcugaacuugaagacgucauuccacuguuauggcgcaugcaccaaauacgaauaucccuggcauacugccaagugucacuacgagcgagauuaucaguacgaaacaaguugggggugcaauccuagcgacuguccaggagugggcaccgguugcacagcuugcgggcucuaccuggaccaauuaaagcccguuggcucggccuauaaaauaauuacuauccgcuacuccagaaggguguguguccaguuuggagaggaaaaccugugcaagauuaucgauaugaaugacuguuucgugucucggcauguuaaagugugcauaaucggcaccguaagcaaguuuucacagggggauacgcuacucuucuuuggaccgcuggaggguggcgggcuuauuuucaaacacugguguaccaguacaugccaguuuggagacccuggcgauaucauguccccacgcgacaaggguuucuugugucccgaguucccugggucuuuuaggaaaaagugcaacuucgcaacuacuccccugugugaauaugauggcaauauggucagcggauacaagaaagugauggcuacaauugacuccuuucaaucauucaacacuagcaccaugcacuuuacggaugagagaaucgaauggaaggacccagauggcaugcuccgugaccauauaaacauucuggugacaaaagauaucgacuucgagaauuuaggggaaaacccuugcaagaucggacugcagaccaguucuauugagggcgccugggguuccggggucggauuuacucuuacauguuugguuagccucaccgagugccccacuuuccugaccucgaucaaagcgugcgacaaggccauuuguuauggcgcugaaucagugacacuaacgcggggucagaauaccguaaaggugucuggcaaagggggacacaguggcuccacuuuuaagugcugucauggggaggaaugcagccagauaggacugcacgcagccgcuccacaucucgauaaagucaacggcaucucugagauugaaaauaacaagguguacgacgauggugccccgcaaugugggaucaaaugcugguucguuaagagcggagaguggauuuccggcaucuuuucagguaauuggauagugcugaucguccuuuguguguucuugcuguucaguuuaauucuccugagcauccuuugcccuguucgaaagcacgagaaaucuuga

SEQ ID NO: 10112 - RNA, 3408 nt, Artificial Sequence
  derived and/or modified CDS sequence (opt3) from HTNV(CGRn93P8)__EF990918.1__GP
augggcaucuggaaguggcuggugauggccagccucgucuggcccgcuuacacccuuagaaacguuuaugacaugaaaauugagugcccucacacaguguccuucggggaaaauucuguaauaggauacguggagcugccaccgauccccuuggcagauacuacgcagauggucccugaaucaaguuguagcauggacaaccaucaauccuuaaauaccauuacaaaguauacucaggugucuuggagggguaaagccgaucaggcgcaggcuucgcaaaacucauuugaggccguuagcgcagaaguggaccugaagggcacuugcguccuaaaacacaagaugcucgaggagaguuaccggucccgcaagucuaucgccuguuaugaucugagcugcaauuccacauacuguaaaccaacccuuuauaugauugugcccauccaugcuugcaacaugaugaagucaugucugauagcauuggggccucaccgaguacagguuguguacgaacguacuuacugcaugacaggaguccucaucgagggcaaauguuucgugccagacagaaguguggucagcauuaucaagcaugguauuuuugauaucgccucuguucacauagugugcuucuuuguagcugugaaagggaauaacuauaagauuuucgaacagaucaagaaauccuuugagucaaccuguaaugacacgaagaacaaaguccagggauacuauauuugcaucgugggcggcaauagcgcccccaucuacguuccuacucuggaugacuucaggaguauggaggcguuuucugggauuuuccgguccccacacggagaagaucaugaccuggccggugaggaaauagcaagcuauucgaucgugggcccggcuaacgccaaggucccccacucugcauccucagauacccucaguuuaacagcuuacagcgggauuccuuccuauucuagccugucaauccuugccggaagugcggaggccaaacauguguuuuccccaggcuucuuuccccaauugaaucacacuaagugcgacaaaaccgcaauaccucugauguggacagguaugauugaccuaccaggguacuacgaagcuauccaccccuguaccguauucugcguucucagcggaccgggcgccucuugugaggcuuucucagagggcgggaucuuuaacauuacgaguccuaugugccuggugagcaagcagaaucgcuucagacuuacugaacagcaggucaacuuugugugucaaagggucgauauggacaucauuguguauugcaacggacagcggaagguuauacugacaaaaaccuuggugaucggucaguguauuuacacuaucacaucccucuucucucuguuacccggcguagcccauucgaucgcagucgagcugugcgugccaggguuucacggaugggccaccgcugcgcuccuuguuacguucuguuuuggcugggugcugauuccugcaaugaccuucauagucuugacaauccuaaaguuuauugccaauaucuuccauacuagcaaccaagaaaauaaacugaaguccgugcuccgcaaaauuaaggaggaauuugagaagaccaaagguucaaugguaugcgauguguguaaguaugagugcgaaacauacaaagagcugaaggcucacgggguuaguugcccccagucucaguguccauauugcuucacucauugugaacccaccgaggccgcauuucaggcccacuaccgagucugccaagugacacacagauucagggacgaucuuaaaaagaccgugacuccucagaacuucacgccagucuguuaucggacacugaauuuguuucguuacaagagccgcugcuacaucuucaccauguggguuuuucuccugguguuagaauccauacugugggcugccucagcaagcgagaucccgcuaaaccccguguggaaugacaacgcgcauggcguaggaucugucccuaugcacacugaucucgagcuggacuucucccuuaccaguagcucuaaauauacauacagaaggaaguugaccaauccacuggaagagucccaggcuauuaaccuccauaucgaaauugaggagcagacuaucggcguggauguucacgcccuggggcacugguuugacggacggcuuaaucugaaaacaucauuccauuguuauggugcaugcacgaaguacgaauaucccuggcacaccgccaaaugucauuacgagcgagauuaucaauacgaaaccaguuggggcugcaacccuagcgacuguccaggggugggaacaggcugcaccauaugcgguuuguaccucgaccagcugaagcccgucgggucggcuuauaagauuaucacaauucgcuacuccagaaggguguguguucaguuuggcgaggaaaauuuaugcaaagugaucgauaugaacgacuguuucguaucucggcacgucaaggugugcauaaucggaacugugagcaaauuuucacagggcgauacccugcuauucuuugggccgcucgagggagguggccugauuuucaagcauugguguacgaguaccugccaauuuggggacccuggagauaucauguccccacgcgacaaaggcuuccuuugucccgaguucccugguucuuuuagaaagaaaugcaauuucgccacaacucccgucugugaauaugaugggaacaugguuagcggcuacaagaaggugauggcaaccauugacuccuuucagucauucaacacaagcacuaugcacuuuaccgaugagaggaucgaauggaaagacccagauggaauguugcgugaccacauaaauauucugguaacgaaggauaucgacuucgacaaccucggcgagaauccuugcaaaaucgggcugcagacaaguucuauugaaggagcuuggggcuccggugugggguuuaccuuaacuugucugaucagccuuacagagugccccaccuucuugacuucgauuaaggccugcgauaaagcgauauguuauggagccgagucagucacccucacacggggccagaacacggugaagguuucugguaagggcgggcauaguggauccaccuuuaaaugcugucacggcgaagacugcagccaaucugggcugcaugcugcagccccacaccuagauaaggugaauggaaucagcgagauugaaaacuccaaagucuacgacgauggcgcuccgcagugugguaucaagugcugguucgugaaaucaggggaguggauuaguggaaucuuuagcggcaauuggauaguucugaucgugcucugugucuuccugcuuuucucuuugguacuguuauccauucucugcccugugcgaaagcauaagaaaucauga

SEQ ID NO: 10113 - RNA, 3408 nt, Artificial Sequence
  derived and/or modified CDS sequence (opt3) from HTNV(CGRni1)__EU363815.1__GP
augggcaucuggaaguggcuggugauggccagccucgucuggcccgcuuucgcacuuagaaaccuguacgacaugaaaauugagugcccucacaccguuuccuuuggggaaaauucugugacaggauauguagaguugccaccgaugcccuuagccgauacuacgcagauggugccugaaucaaguuguagcauggacaaccaucaaucccugaauaccauaacaaaguacacucagaucauuuggagggguaaagcggaucagucucagucgucacaaaacagcuucgagaccgucaguacagaaguggaccuaaagggcacuugcguucucaaacacaagaugaucgaggaguccuaucggucucgcaagagcauuacuuguuacgaucuguccugcaauucaacauauuguaaaccaacccuuuacaugaucgugcccauacaugcuugcaacaugaugaagaguugucugaucgccuuggggccuuaucgaguccaggugguauacgaacguacguacugcaugacuggaguucucauugagggcaaauguuuugugccagaccagagcgucgugucuaucauuaagcacgguaucuucgauauagcauccgugcauauugucugcuuuuauguugccgugaaagggaauaccuacaagaucuucgaacagguaaagaaaacauuugagucaaacuguaaugacacugagaacaaggugcaaggauauuacauuugcaucaucggcggcaauagcagucccgucuaugugccuacccuggaugacuucagaucuauggaagcauuuuccgggauuauaaggagcccacacggagaggaucacgaccuggcuggugaagagguugccucguacucuaucgugggcccggcuaacgccaaagucccccauuccgcgucaagugauacacucggguuaauugcauauagcuccaucccuucuuacagcucacugaguauacuuaccuccagcacggaagccaagcacguguucucuccaggauuguuuccccagcugaaucauacuaaaugcgacaagacagcuauuccucuaaccuggacuggcaugaucgaccucccagguuacuaugaggccauccaccccuguacaguauucugcguucugucagggccgggagcaaguugugaggcuuuuagcgaaggcggcauuuucaacaucgccuccccuaugugccuugugucuaaacagaaucgguuccgccugaccgagcagcaagucaacuuugugugucagagagucgauguggacauuauaguuuacugcaacgggcagaggaaggugaucuugacgaagacccucguaauuggacaauguaucuauacaaucacuucgcuguucagcuuacugcccggugucgcgcacuccauugccguggaacucugcguuccaggcuuucaugggugggcaaccgcugcccuucuggugacauucuguuuuggaugggucuugauaccugcuaucacuuucauuauccuaaccauucugaaauuuaucgccaauauauuccacacaucaaaccaggagaaucggcucaagagugugcugcgcaaaaucaaggaagaguuugagcgaaccaugggcucuaugguaugcgauauuuguaaauacgaaugcgagacuuauaaggaacuuaaggcacauggugugagcugcccccagucccaguguccauacugcuucacgcacugugagcccacagaagccgcuuuucaagcgcauuauaaaguuugccaggucacccacagauucagggacgaucugaagaaaacugugacccggcagaacuuuacaccuggguguuaccguaccuugaaucucuuccgcuacaagucaagaugcuauaucuucacuauguggguguuucugauugucuuagagagcauccugugggcagccucugcuuccgagauaccacuaaacccgguuuggaaugacaacgcccacggcgugggaaguauucccaugcauacagaucucgaacuggacuucagccuuacgucuuccucaaaauacaccuauaggcggaaguugacuaauccucuggaggaaagucaggcaaucgaucuccacguggagauugaggaacaaacaaucggcguagacguccaugcccuggggcacugguuugauggacgacuuaaccugaagaccagcuuccacuguuacggugcuugcacaaaauaugaguacccauggcauacugccaagugucacuaugaacgcgacuaccaguacgagaccucguggggcugcaaucccuccgacuguccuggggugggaacgggcugcaccgcaugcgguuuguaucucgaucagcugaaaccaguugggucugcguacaagauaaucacaauuagauauagcaggcggguguguguccaguuuggcgaagagaacuuaugcaaaaucauugacaugaaugauuguuucgugucacgccauguuaaggugugcaucauaggaacuguaaguaaguuuucccaaggcgacacccugcuauucuuugggccccucgagggagguggccugauuuucaaacacugguguacaucuacuugccaguuuggggauccgggagacaucaugagcccuagagauaagggcuuccuuuguccagaauuucccgguuccuucaggaaaaagugcaacuucgcuaccacgccugucugugaguacgacgggaauauggugucaggcuauaaaaaggugauggccacaaucgauagcuuucagaguuucaacaccucuacuaugcauuuuacagacgaacguauugaguggaaagaucccgacggaauguugcgggaucacaucaacauucuggucaccaaggacauagacuucgauaaucucggcgaaaacccaugcaagaucgggcugcagacuuccagcauugagggagcauggggcucggguguuggguuuaccuuaacaugucugaucucacuuacggagugcucuaccuucuugaccaguauuaaagccugcgacaaggcuaucuguuacggagccgaauccgugacacucacccgaggccaaaauacaguaaaagugagcgguaagggcgggcacucuggaagcuccuuuaaaugcugucauggcgaggaaugcucacagauagggcugcacgcagcugccccucaucuagauaaggucaacggaaucagugagauggaaaauagcaagguguucgacgauggcgcgccccagugugguauuaaaugcugguuuguuaagucuggggaguggaucuccggaauuuucucaggcaacuggaucgugcugauaguccucuguguguuucugcuuuucaguuugguucuguuaagcauucucugcccagugagaaaacacaagaaauccuga

SEQ ID NO: 10114 - RNA, 3408 nt, Artificial Sequence
  derived and/or modified CDS sequence (opt3) from HTNV(Aa10-434)__KU207160.1__GP
augggcaucuggaaguggcuggugauggccagccucgucuggcccguucuuacccugagaaacguguacgacaugaaaauugagugcccucacacaguauccuucgggggaaauucugugauagguuaugucgaauugccaccgaugcccuuagcugauacugcacagcuggugccugagucaaguuguagcauggacaaccaucaaucccuaaauacgaucaccaaguacacacagguuucuuggaggggcaaagccgaucagucgcagucaagccaaauuaguuuugaaacuguguccaccgaggucgaccucaaggggacaugcgugcugaaacacaagaugguagaagagucuuaucggagccgcaaguccaucaccuguuacgaucuuucaugcaacaguacuuauuguaaaccaacacuguacaugauuguucccauccaugcgugcaauaugaugaaaagcuguuugauagcucucggaccuuaucgagugcaggucguguacgagcguaccuacugcaugacgggcgugcugaucgaagguaaauguuucgucccagaccagucuguuguguccauuaucaagcacgggauuuuugauaucgccucaguacauauagugugcuucuuugucgcagugaaaggaaacacuuauaagauuuucgagcagguuaagaaaaguuuugaaaguaccuguaaugacacagagaacaaggugcaaggcuacuauaucugcauugucggcgggaauagcgcccccaucuacgugccuacucuggaugacuucagauccauggaggcuuuuaccggaaucuucaggagcccacacggugaagaucacgaccucgcaggcgaggaaacagccaccuauucgauuguagggccggcuaacgccaaaguuccccauucugcguccucagauacguuaagucugauagcauuuagcggaaucccuuccuacucuagccuuucaauuuugacuagcuccacagaggccaagcacguguucagcccaggccuguuucccaaacuaaaucauaccaacugcgacaagggugcuaucccucucauguggacugggaugauagaccugccaggauauuacgaagccauucaccccuguacagucuucugcgugcuuucuggcccgggcgcaucaugugaggcuuucagugaagggggaaucuuuaauaucaccagcccuaugugccuggucuccaaacagaaccgguuccgcuugacggagcaacaggugaauuuuguuugucaaagaguggauguagacauugucguguacugcaacggucagaggaagguuauccucaccaagacacuggugauuggccaguguauauauacuaucaccucuuuauucucgcugcuccccggggucgcccacagcauugcgguggagcuuugcguaccaggauuucauggcugggccacagcagcucuguuggugacuuucuguuuugguuggguucuaaucccugccaucaccuucauuauacugacaauccucaaauuuauugcuaacaucuuccacaccuccaaucaagaaaaccggcugaagucaguccuucgcaaaauuaaggaggaauuugagaaaacuaaggggaguauggugugcgauaucuguaaguacgagugcgaaacguauaaagagcugaaggcccauggcgugucuugcccccagagccaguguccauacugcuucacacacugugaacccaccgaggcagccuuucaggcucauuauaaagucugccaaguuacucaccgauucagagacgauuugaagaaaaccgugacaccucagaauuucaccccaggauguuacaggacucucaaccuguuucgguauaagucccguugcuacauauucacaauguggaucuuuuuacuggugcuagaaucaauucucugggcggcaagcgccucugagacgccgcugacccccguauggaaugacaacgcucacggcgucggguccgugccuaugcauacugaucuugaguuggacuucagucugacaucuucuuccaaguacaccuaucgcagaaaacucacaaauccacuggaagaggcccagucaaucgaucuucacauugaaaucgaggagcagacuauaggaguugacgugcaugcacugggucacugguuugauggcagguugaaccucaagaccaguuuccacuguuacggggccugcacgaaauaugaauaccccuggcauaccgcuaagugucacuaugagcgggacuaccaauaugaaacaagcuggggaugcaauccuucggacuguccaggcgucgguacugggugcaccgccugcggccuguacuuagaucgacugaaacccgugggauccgcauacaagauuaucacaauucgcuauucuagaaggguuugugugcaguuuggcgaggaaaaccuaugcaagaucauagacaugaaugauuguuucguaagccggcaugucaaagugugcaucauugggacuaucucaaaguuuagucagggagacacccuccuguucuuugguccgcuugagggcgggggauugauuuucaaacacugguguacguccacaugccaguuuggcgauccuggugacaucaugucuccacgcgauaagggguuccugugucccgaguucccuggcagcuuuagaaagaagugcaacuucgcgaccacucccauaugugaauacgacggaaauaugguguccggcuauaaaaaggucauggcuacaauugauucauuucagagcuucaacaccaguacuaugcauuuuaccgacgagaggaucgaauggaaggauccagacgggaugcuccgugaucacaucaauauucugguuacaaaagacaucgacuucgauaacuuaggagagaacccuugcaagauuggccugcaggccucuuccauagaaggugcaugggggagcggagugggcuuuacgcuuaccuguuugguaucgcucacugagugccccacauuccugaccucaaucaaagccugcgacaaggcuauuuguuacggugccgagucugugacacuaacucggggccagaauaccgucaaagugagugggaagggaggccacuccgggagcacguuuaagugcugucauggagaagauugcucucagaucggccugcacgcagcugccccacaucucgacaaaguuaacgguauuagcgagauggaaaauuccaagguguaugaugacggggcgccgcaauguggaaucaaaugcugguucgucaagucaggcgaguggauaagugguaucuuuagcggcaacuggauugugcugaucguucuuuguguguucuugcuguucucuuuaguccuccuguccauucuuugcccuguacgaaaacacaagaagucauga

SEQ ID NO: 10115 - RNA, 3408 nt, Artificial Sequence
  derived and/or modified CDS sequence (opt3) from HTNV(Aa10-518)__KU207161.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaagaguuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaucuuuugagaguaccuguaacgacacaaagaauaaagugcaaggauacuauauuugcaucgucggcggcaacucugcccccauuuacgugccuacucuggaugacuucagauccauggaggcuuuuaccgggaucuucaggagcccacacggagaagaucacgaccucgcaggggaggaaacagccaccuauucgaucguaggcccggcuaaugccaagguuccccauucugcguccucagauacguuaagucugauugcauuuagcgggauaccuuccuacucuagccuuucaaucuugacuagcuccacagaggccaaacacguguucagcccaggacuguuucccaagcuaaaccauaccaauugcgacaaaggcgcuauuccucucauguggacugguaugaucgaccugccaggguauuacgaagccauacaccccuguacagucuucugcgugcuuucuggaccgggcgcaucaugugaggcuuucagugagggcgggauuuuuaacaucaccagcccuaugugccuggucuccaagcagaaucgguuccgcuugacggaacaacaggugaacuuuguuugucaaagaguggauguagacaucgucguguacugcaacggacagaggaagguuauucucaccaaaacacuggugaucggucaguguauuuauacuauaaccucuuuauucucgcugcuccccggcgucgcccacagcaucgcgguggagcuuugcguaccaggguuucauggaugggccacagcagcucuguuggugacuuucuguuuuggcuggguucuaauuccugccaucaccuucaucauucugacaauacucaaguuuaucgcuaauauuuuccacaccuccaaccaagaaaaucggcugaaaucaguccuucgcaagaucaaagaggaauuugagaagacuaaggguaguauggugugcgauauuuguaaauacgagugcgaaacguauaaggagcugaaagcccauggggugucuugcccccagagccaguguccauacugcuucacacacugugaacccaccgaggcagccuuucaggcucauuauaaggucugccaaguuacucaccgauucagagacgauuugaaaaagaccgugacaccucagaacuucaccccaggcuguuacaggacucucaaucuguuucgguauaagucccguugcuacaucuucacaauguggauauuuuuacuggugcuagaaucaauccucugggcggcaagcgccucugagacgccgcugacccccguauggaacgacaaugcucacggagucggcuccgugccuaugcauacugaucuugaguuggacuucagucugacaagcagcuccaaauacaccuaucgcagaaagcucacaaacccacuggaagaggcccagucaauugaucuucacaucgaaauugaggagcagacuaucgggguugacgugcaugcacugggacacugguuugaugguagguugaaucucaaaaccaguuuccacuguuacggcgccugcacgaaguaugaauaccccuggcauaccgcuaaaugucacuaugagcgggacuaccaauaugaaacaagcugggggugcaacccuucggacuguccaggagucggcacugguugcaccgccugcgggcuguacuuagaucgacugaagcccgugggcuccgcauacaagauaauuacaauccgcuauucuagaaggguuugugugcaguuuggagaggaaaaucuaugcaaaauuguagacaugaacgauuguuucgucagccggcaugugaaggugugcaucauaggcacugucucaaaauuuagucagggggacacccuccuguucuuuggaccgcuugaggguggcggguugaucuucaagcacugguguacguccacaugccaguuuggagauccuggcgacauuaugucuccacgcgauaaagguuuccugugucccgaguucccugggagcuuuagaaagaaaugcaauuucgcgaccacucccaucugugaauacgacggcaacaugguuuccggauauaagaaggugauggcuacaauugauucauuucagagcuucaauaccaguacuaugcauuuuaccgacgagaggaucgaauggaaagauccagacggcaugcuccgugaucacauaaacauucugguaacaaaggacaucgacuucgauaacuuaggggagaauccuugcaaaaucggacugcagacgucuuccauugaaggcgccugggguagcggggugggauuuacccuuacuuguuuggucucgcucacagagugccccaccuuccugacaucaaucaaggcaugcgacaaagccauuuguuacggcgcugagucugugacucuaacccggggucagaacacgguuaaggugaguggcaaggguggacacuccggcagcacauuuaaaugcugucauggggaagauugcucucagauaggacugcacgccgcagcuccacaucucgacaaggucaauggcaucagcgagauggaaaacuccaaaguguaugaugacggugccccgcaaugugggauuaagugcugguucguuaaaucaggagaguggaucaguggcauuuuuagcgguaauuggaucgugcugauaguccuuuguguauucuugcuguucucuuuagugcuccuguccauccuuugcccuguucgaaagcacaagaaaucauga

SEQ ID NO: 10116 - RNA, 3408 nt, Artificial Sequence
  derived and/or modified CDS sequence (opt3) from HTNV(Aa13_3)__KX687227.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuaguggauacuguucagcuggugccugaaucaaguuguagcauggacaaccaucaaucccuaaauacgaucaccaaguacacacaggucucuuggagggguaaagcugaucagucgcagucaagccaaaacaguuuugagacuguguccaccgaaguagaccucaagggcacaugcguucugaaacacaagaugguggaggagucuuaucggagccgcaaguccauuaccuguuacgaucuuucaugcaauaguacuuauuguaaaccaacacuguacaugaucguccccauucaugcaugcaacaugaugaaaagcuguuugaucgcccucgggccuuaucgaguccaggugguguacgaacguaccuacugcaugacgggaguucugauagagggcaaauguuucgugccagaccagucuguaguguccaucauuaagcacgguaucuuugauauugcgucaguccauaucgugugcuucuuuguugcugugaaagggaauacuuauaagauauucgaacaggucaagaaaaguuuugagaguaccuguaacgacacagagaauaaggugcaaggauacuauauuugcaucguaggcggcaacucugcccccauuuacguuccuacucuggaugacuucagauccauggaagcauuuaccgggaucuucaggagcccacacggagaggaucacgaccucgccggugaagagacagcuaccuauucgaucgugggcccggcaaaugccaaagucccccauucugcuuccucagauacguuaagucugauugccuuuagcgggauaccuuccuacucuagccuuucaaucuugacuagcuccacagaagcgaagcacguguucagcccaggacuguuucccaaacuaaaccauaccaauugcgacaagggcgcaauuccucucauguggacugguaugaucgaccugccaggguauuacgaggccauacaccccuguacagucuucugcgugcuuucuggaccgggcgcuucaugugaggccuucagugaaggcgggauuuuuaacaucaccagcccuaugugccugguuuccaaacagaaucgguuccgcuugacggagcaacaggugaacuuuguaugucaaagagucgauguggacaucguuguguacugcaacggacagaggaaggucauucucaccaagacacuggugaucggucaguguauuuauacuauaaccucuuuauucucgcugcuccccggcguagcacacagcaucgcuguggaacuuugcguuccaggguuucauggaugggccacagcggcccuguuggucacuuucuguuuuggcugggugcuaauuccugcaaucaccuucaucauucugacaauacucaaauuuaucgcuaauauuuuccacaccuccaaccaagagaaucggcugaagucagugcuucgcaaaaucaaggaagaguuugagaaaacuaaggguaguauggucugcgauauuuguaaguacgaaugcgagacguauaaagaacugaaggcccaugggguuucuugcccccagagccaguguccauacugcuucacacacugugagcccaccgaagcugccuuucaggcacauuauaaagugugccaagugacucaccgauucagagacgauuugaagaaaaccguaacaccucagaacuucaccccaggcuguuacaggacucucaaucuguuucgguauaagucccguugcuacaucuucacaauguggauauuuuuacugguccuagagucaauccucugggccgcuagcgcgucugagacgccgcugacccccguguggaacgacaaugcacacggaguuggcuccgugccuaugcauacugaucuugaauuggacuucagucugacaucuagcuccaaguacaccuaucgcagaaaacucacaaacccacuggaggaagcccagucaauugaucuucacaucgagauugaggaacagacuaucggggucgacgugcaugcucugggacacugguuugaugguagguugaaucucaagaccaguuuccacuguuacggcgccugcacgaaauaugaguaccccuggcauaccgcaaagugucacuaugaacgggacuaccaauaugagacaagcugggggugcaacccuucggacuguccaggaguuggcacugguugcaccgccugcgggcuguacuuagaucgacugaaacccgugggcuccgcuuacaagauaauuacaauccgcuauucuagaaggguauguguccaguuuggagaagagaaucuaugcaagauuaucgacaugaacgauuguuucgugagccggcaugugaaagucugcauaaucggcacuguuucaaaguuuagucagggggacacccuccuguucuuuggaccgcuugaggguggcggguugauuuucaaacacugguguacguccacaugccaguuuggagauccuggcgacaucaugucuccacgcgauaaggguuuccugugucccgaguucccugggagcuuuagaaagaagugcaauuucgccaccacucccauuugugaauacgacggcaacaugguguccggauauaaaaagguaauggcaacaaucgauucauuucagagcuucaauaccaguacuaugcauuuuaccgacgaaaggauagaguggaaggauccagacggcaugcuccgugaucacauuaacauccuggugacaaaagacaucgacuucgauaacuuaggggaaaauccuugcaagauuggacugcagacgucuuccaucgagggcgcgugggguagcggggucggauuuacccuuacuuguuuggugucgcucacagagugccccaccuuccugacaucaauuaaggcuugcgacaaggccauauguuacggcgcagaaucuguuacucuaacccggggucagaacacggugaaagucaguggcaaagggggacacuccggcagcacauuuaagugcugucauggggaggauugcucucagaucggacugcacgccgcugccccacaucucgacaaagugaauggcauuagcgaaauggagaacuccaagguuuaugaugacggugcaccgcaaugugggaucaaaugcugguucgugaagucaggagaauggauuaguggcaucuuuagcgguaauuggauaguccugaucguacuuuguguguucuugcuguucucuuuaguucuccuguccauucuuugcccugugcgaaaacacaagaagucauga

SEQ ID NO: 10117 - RNA, 3408 nt, Artificial Sequence
  derived and/or modified CDS sequence (opt3) from HTNV(Aa14_186)__KX687228.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugauugaggagucuuaucggagccgcaaguccaucaccuguuacgaucuuucaugcaauaacacuuauuguaaaccaacacuguacaugauuguacccauccaugcgugcaauaugaugaagaguuguuugauagcucucgggccuuaucgaguucagguggucuacgaacguaccuacugcaugacgggagugcugaucgagggcaaauguuucgugccagaccagagcgucguuucuauuaucaagcacgguauuuuugauaucgccuccgugcauauaguaugcuucuuuguggcagucaaagggaacacuuauaagauuuucgaacaggugaagaaaucauuugagagcaccuguaaugacacagagaacaagguucaaggauacuauaucugcauugugggcggcaauagugcccccaucuacgucccuacucuggaugacuucagaucuauggaagcauuuaccgggaucuucagguccccacacggagaggaucacgaccucgcuggugaagagacagccaccuauagcauugugggcccggcuaacgccaaaguaccccauucggcgucuuccgauacguuaucacugauagcauuuagugggaucccuagcuacuccucucuuagcauuuugacuucaaguacagaagccaagcacguuuucuccccaggacuguuucccaaacuaaaucauaccaacugcgacaagggcgcuaucccucucauguggacugguaugauagaccugccaggguauuacgaggccauucaccccuguacaguguucugcguccuuagcggaccgggcgcaucuugugaggcuuucucagaaggcgggaucuuuaauaucaccaguccuaugugccuggugagcaaacagaaccgguuccgcuugacggagcagcaggucaacuuugugugucaaagaguugauguggacauuguagucuacugcaauggacagaggaaggugauccucaccaagacacugguuauuggucaguguauauauacuaucaccuccuuauucucucugcuccccggcguggcccacucgauugcggucgaacuuugcgugccaggguuucauggaugggccacagcagcucuguugguaacuuucuguuuuggcugggugcuaaucccugccaucaccuucauuauacugacaauccucaaauuuauugcuaacaucuuccacaccagcaaucaagagaaccggcugaaguccguucuucgcaaaauuaaggaagaguuugagaaaacuaaggguucaauggucugcgauaucuguaaguacgaaugcgagacguauaaagaacugaaggcccauggggugaguugcccccagucucaguguccauacugcuucacacacugugagcccaccgaagcagccuuucaggcucauuauaaagugugccaagucacucaccgauucagagacgauuugaagaaaaccguuacaccucagaauuucaccccaggcuguuacaggacucucaaccuguuucgguauaagagccguugcuacauauucacaauguggaucuuuuuacuggugcuagaguccauucucugggcggcaucagccagcgagacgccgcugacccccguguggaaugacaacgcucacggaguaggcucugucccuaugcauacugaucuugaauuggacuucucccugacaaguagcucuaaguacaccuaucgcagaaaacucacaaauccacuggaggaagcccaguccaucgaucuucacauugagaucgaggaacagacuauagggguggacguucaugcacugggacacugguuugaugguagguugaaccucaagaccucauuccacuguuacggcgccugcacgaaauaugaguaccccuggcauaccgcuaagugucacuaugaacgggacuaccaauaugagacaaguugggggugcaauccuagcgacuguccaggagugggcacugguugcaccgccugcgggcuguacuuagaucgacugaaacccgucggcucggcauacaagauuaucacaauucgcuauuccagaaggguguguguucaguuuggagaagagaaccuaugcaagaucauagacaugaaugauuguuucgugucucggcauguaaaagucugcaucauuggcacugugagcaaguuuucacagggggacacccuccuguucuuuggaccgcuugaggguggcggguugaucuucaaacacugguguacgaguacaugccaguuuggagauccuggcgacauuauguccccacgcgauaaggguuuccugugucccgaguucccugggucuuuuagaaagaagugcaacuucgcgaccacucccaucugugaauacgacggcaauauggugagcggauauaaaaaggucauggcuacaauagauuccuuucaaucauucaacaccagcacuaugcauuuuaccgacgaaaggauugaguggaaggauccagacggcaugcuccgugaucacaucaacauccugguuacaaaagacauugacuucgauaauuuaggggaaaacccuugcaagaucggacugcagacgaguucuauugagggcgccugggguuccggggugggauuuacccuuacuuguuugguaagccucacagagugccccaccuuccugacaucgauaaaagcaugcgacaaggccaucuguuacggcgcugaaucagugacucuaacccggggucagaauacggucaaagugucuggcaaagggggacacaguggcuccacauuuaagugcugucauggggaggauugcagccagauuggacugcacgccgcagcuccacaucucgacaaaguuaacggcaucucugaaguggagaauagcaaggucuaugaugacggugccccgcaaugugggauuaaaugcugguucgugaaguccggagaauggaucucaggcauauuuagugguaacuggaucguucugauugugcuuugugucuucuugcuguucagcuuaguacuccugucuauccuuugcccugugcgaaaacacaagaaguccuga

SEQ ID NO: 10118 - RNA, 3408 nt, Artificial Sequence
  derived and/or modified CDS sequence (opt3) from HTNV(Aa14_234)__KX687230.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaacuagcuuugagaccguguccacagaagucgaccucaaggggaccugcgugcugaaacacaagaugguagaggagucuuaucggagccgcaaguccauuacuuguuacgaucuuucaugcaacaguacauauuguaaaccaacccuguacaugaucguucccauucaugcgugcaauaugaugaaaagcuguuugaucgcucucgggccuuaucgagugcaggucguguacgaacguacguacugcaugacuggagugcugauagagggcaaauguuucgucccagaccagucuguuguguccaucauuaagcacgguaucuuugauauugccucaguacauaucgugugcuucuuugucgcagugaaagggaacaccuauaagauauucgaacagguuaagaaaaguuuugagaguacauguaaugacacugagaacaaggugcaaggauacuauauuugcaucgucggcggcaauucugcccccauuuacgugccuacccuggaugacuucagauccauggaagcauuuacagggaucuucaggagcccacacggagaggaucacgaccucgcuggugaagagaccgccacguauucgaucguaggcccggcuaacgccaaaguuccccauucugcguccucagauacuuuaagucugauugcauuuagcgggauaccuuccuacucuagccuuucaaucuugacaaguuccaccgaagccaagcacguguucagcccaggacuguuucccaaacuaaaucauacuucuugcgacaagggcgcuauuccucucauguggacagguaugaucgaccugccaggguauuacgaggccauacaccccuguaccgucuucugcgugcuuucaggaccgggcgcaaguugugaggcuuucagcgaaggcgggauuuuuaacaucacguccccuaugugccuggucucuaaacagaaucgguuccgcuugaccgagcaacaggugaacuuuguuugucagagaguggauguagacaucgucguguacugcaauggacagaggaagguuauucucacaaagacucuggugaucggucaguguauuuauaccauaacaucguuauucagccugcuccccggcgucgcccacuccaucgcgguggaacuuugcguaccaggguuucauggaugggccacugcagcucuguuggugaccuucuguuuuggcuggguucuaauuccugccaucacauucaucauucugaccguccucaaauuuauagcuaacaucuuccacacuucaaaccaagagaaucggcugaagagugugcuucgcaaaauuaaggaagaguuugagaaaacgaaggguucuauggugugcgauaucuguaaguacgaaugcgagacauauaaagaacugaaggcccauggggucagcugcccccagucccaguguccauacugcuucacccacugugagcccacugaagcagccuuucaggcucauuauaaaguuugccaagugacccaccgauucagagacgauuugaagaaaacagugaccccucagaacuucacuccaggcuguuacaggacacucaaucuguuucgguauaagucacguugcuacauuuucacgauguggaucuuuuuacugguacuagagagcauacucugggcggcaucugccuccgagaccccgcugacucccgucuggaacgacaaugcucacggagugggcaguguuccuaugcauacagaucuugaauuggacuucagccugaccucuuccucaaaguacacauaucgcagaaaacucacuaacccacuggaggaagcccagaguaucgaucuucacauugagaucgacgagcagaccauugggguggauguccaugcacugggacacugguuugacgguagguugaaucucaagacgagcuuccacuguuacggcgccugcaccaaauaugaauaccccuggcauacagcuaagugucacuaugagcgggacuaccaauaugaaacuucgugggggugcaacccuuccgauuguccaggagugggcaccgguugcacagccugcgggcuguacuuagaccgacugaaacccguuggcucugcauacaagaucauaacuauucgcuauagcagaaggguguguguacaguuuggagaggaaaaucuaugcaagaucauugauaugaacgacuguuucgucucacggcaugugaaagugugcaucauaggcaccgucaguaaguuuucccagggggauacgcuccuguucuuuggaccgcuugaggguggcggguugaucuucaaacacugguguacaucuaccugccaguuuggagacccuggcgauauuaugagcccacgcgacaaggguuuccugugucccgaguucccuggguccuuuagaaagaagugcaauuucgcgacuacacccaucugugaauacgauggcaacaugguuucaggauauaaaaaggugauggcuaccauugacagcuuucaaaguuucaauacuucuaccaugcauuuuacagaugagaggaucgaauggaaggacccagauggcaugcuccgugaccacauaaacauucugguaacgaaagacaucgauuucgacaauuuaggggagaacccuugcaagaucggacugcagaccuccagcauugaaggcgccugggguucgggggugggauuuacucuuacauguuuggucucacucaccgagugccccacauuccugacuucuaucaaagcaugcgauaaggccauuuguuacggcgcugagagugugacccuaacgcggggucagaacacaguuaaaguguccggcaagggcggacacagcggcucuaccuuuaagugcugucauggggaagacugcagccagauaggacugcacgccgcagcuccacaucucgauaaagucaauggcaucuccgagauggaaaacucaaagguguaugacgauggugccccgcaaugugggauuaaaugcugguucguuaagaguggagaguggaucagcggcaucuuuucugguaauuggauugugcugauaguccuuuguguauucuugcuguucuccuuagugcuccugucaauccuuugcccuguucgaaaacacaagaagaguuga

SEQ ID NO: 10119 - RNA, 3408 nt, Artificial Sequence
  derived and/or modified CDS sequence (opt3) from HTNV(Aa14_239)__KX687231.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaagaguuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaucuuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgaccugccaggguauuacgaggccauacaccccuguacagucuucugcgugcuuucuggaccgggcgcaucaugugaggcuuucagugaaggcgggauuuuuaacaucaccagcccuaugugccuggucuccaaacagaaucgguuccgcuugacggagcaacaggugaacuuuguuugucaaagaguggauguagacaucgucguguacugcaacggacagaggaagguuauucucaccaagacacuggugaucggucaguguauuuauacuauaaccucuuuauucucgcugcuccccggcgucgcccacagcaucgcgguggaacuuugcguaccaggguuucauggaugggccacagcagcucuguuggugacuuucuguuuuggcuggguucuaauuccugccaucaccuucaucauucugacaguccucaaauuuauagcuaauaucuuccacaccuccaaccaagagaaucggcugaagucagugcuucgcaaaauuaaggaagaguuugagaaaacuaaggguaguauggugugcgauaucuguaaguacgaaugcgagacguauaaagaacugaaggcccauggggucucuugcccccagagccaguguccauacugcuucacacacugugagcccaccgaagcagccuuucaggcucauuauaaaguuugccaagugacucaccgauucagagacgauuugaagaaaaccgugacaccucagaacuucaccccaggcuguuacaggacucucaaucuguuucgguauaagucccguugcuacauuuucacaauguggaucuuuuuacugguacuagagucaauacucugggcggcaagcgccucugagacgccgcugacccccgucuggaacgacaaugcucacggagugggcuccguuccuaugcauacugaucuugaauuggacuucagucugacaagcagcuccaaguacaccuaucgcagaaaacucacaaacccacuggaggaagcccagucaaucgaucuucacauugagaucgacgagcagacuauugggguggauguccaugcacugggacacugguuugacgguagguugaaucucaagaccaguuuccacuguuacggcgccugcacgaaauaugaauaccccuggcauaccgcuaagugucacuaugagcgggacuaccaauaugaaacaagcugggggugcaacccuucggauuguccaggagugggcacugguugcaccgccugcgggcuguacuuagaccgacugaaacccguuggcuccgcauacaagaucauaacaauucgcuauucuagaaggguguguguacaguuuggagaggaaaaucuaugcaagaucauugauaugaacgacuguuucgucagccggcaugugaaagugugcaucauaggcacugucucaaaguuuagucagggggauacccuccuguucuuuggaccgcuugaggguggcggguugaucuucaaacacugguguacguccacaugccaguuuggagacccuggcgauauuaugucuccacgcgacaaggguuuccugugucccgaguucccugggagcuuuagaaagaagugcaauuucgcgaccacucccaucugugaauacgauggcaacaugguuuccggauauaaaaaggugauggcuacaauugacucauuucagagcuucaauaccaguacuaugcauuuuaccgaugagaggaucgaauggaaggacccagauggcaugcuccgugaccacauaaacauucugguaacaaaagacaucgauuucgacaacuuaggggagaauccuugcaagaucggacugcagacgucuuccauugaaggcgccugggguagcggggugggauuuacccuuacuuguuuggucucgcucacagagugccccaccuuccugacaucaaucaaagcaugcgauaaggccauuuguuacggcgcugagucugugacucuaacccggggucagaacacgguuaaagugaguggcaaagggggacacuccggcagcacauuuaagugcugucauggggaagacugcucucagauaggacugcacgccgcagcuccacaucucgauaaagucaauggcaucagcgagauggaaaacuccaagguguaugacgauggugccccgcaaugugggauuaaaugcugguucguuaagucaggagaguggaucaguggcauuuuuagcgguaauuggaucgugcugauaguccuuuguguauucuugcuguucucuuuagugcuccuguccauccuuugcccuguucgaaaacacaagaagucauga

SEQ ID NO: 10120 - RNA, 3408 nt, Artificial Sequence
  derived and/or modified CDS sequence (opt3) from HTNV(Aa14-172)__KU207162.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuaacugauacggcucagcuggugccugaaucaaguuguagcauggacaaccaucaaucccuaaauaccaucacaaaguacacucagguuucuuggagggguaaagcagaucagucgcagucaagccaaaacaguuuugagaccguguccacagaagucgaccucaagggcacuugcgugcugaaacacaagaugauugaggagucuuaucggagccgcaaguccaucacuuguuacgaucuuucaugcaauaacacauauuguaaaccaacccuguacaugauuguacccauccaugccugcaauaugaugaagaguuguuugauagcgcucgggccuuaucgaguucagguggucuacgaacguacguacugcaugacuggagugcugaucgagggcaaauguuucgugccagaccagagcgucguuucuauuaucaagcacgguauuuuugauaucgcuuccgugcauauaguaugcuucuuuguggccgucaaagggaacaccuauaagauuuucgaacaggugaagaaaucauuugagagcacauguaaugacacugagaacaagguucaaggauacuauaucugcauugugggcggcaauagugcacccaucuacgucccuacccuggaugacuucagaucuauggaagccuuuacagggaucuucagguccccacacggagaggaucacgaccucgcuggugaagagaccgcaacguauagcauugugggcccggccaacgcuaaaguaccccauucggccucuuccgauacuuuaucacugauagcguuuagugggaucccuagcuacuccucucuuagcauuuugacaucaaguaccgaagcaaagcacguuuucuccccaggacuguuucccaaacuaaaucauacuaacugcgacaagggcgccaucccucucauguggacagguaugauagaccugccaggguauuacgaggcuauucaccccuguaccguguucugcguccuuagcggaccgggcgccucuugugaggcauucucagaaggcgggaucuuuaauaucacgaguccuaugugccuggugagcaaacagaaccgguuccgcuugaccgagcagcaggucaacuuugugugucaaagaguugauguggacauuguagucuacugcaauggacagaggaaggugauccucacaaagacucugguuauuggucaguguauauauaccaucacauccuuauucucucugcuccccggcguggcucacucgauugccgucgaacuuugcgugccaggguuucauggaugggcgacugccgcacuguugguaaccuucuguuuuggcugggugcuaaucccugcuaucacauucauuauacugaccauccucaaauuuauugccaacaucuuccacacuagcaaucaagagaaccggcugaaguccguucuucgcaaaauuaaggaagaguuugagaaaacgaaggguucaauggucugcgauaucuguaaguacgaaugcgagacauauaaagaacugaaggcucauggggugaguugcccccagucucaguguccauacugcuucacccacugugagcccacugaagccgcauuucaggcccauuauaaagugugccaagucacccaccgauucagagacgauuugaagaaaacaguuaccccucagaauuucacuccaggcuguuacaggacacucaaccuguuucgguauaagagccguugcuacauauucacgauguggaucuuuuuacuggugcuagaguccauucucugggcugcgucagcaagcgagaccccgcugacucccguguggaaugacaacgcccacggaguaggcucugucccuaugcauacagaucuugaauuggacuucucccugaccaguagcucuaaguacacauaucgcagaaaacucacuaauccacuggaggaagcucaguccaucgaucuucacauugagaucgaggaacagaccauagggguggacguucaugcccugggacacugguuugaugguagguugaaccucaagacgucauuccacuguuacggcgcaugcaccaaauaugaguaccccuggcauacagccaagugucacuaugaacgggacuaccaauaugagaccaguugggggugcaauccuagcgacuguccaggagugggcaccgguugcacagcuugcgggcuguacuuagaucgacugaaacccgucggcucggccuacaagauuaucacuauucgcuauuccagaaggguguguguucaguuuggagaagagaaccuaugcaagaucauagacaugaaugauuguuucgugucucggcauguaaaagucugcaucauuggcaccgugagcaaguuuucacagggggacacgcuccuguucuuuggaccgcuugaggguggcggguugaucuucaaacacugguguacaaguaccugccaguuuggagauccuggcgacauuauguccccacgcgauaaggguuuccugugucccgaguucccugggucuuuuagaaagaagugcaacuucgcaacuacacccaucugugaauacgacggcaauauggugagcggauauaaaaaggucauggcgaccauagauuccuuucaaucauucaacacuagcaccaugcauuuuacagacgaaaggauugaguggaaggauccagacggcaugcuccgugaucacaucaacauccugguuacgaaagacauugacuucgauaauuuaggggaaaacccuugcaagaucggacugcagaccaguucuauugagggcgcuugggguuccggggugggauuuacucuuacauguuugguaagccucaccgagugccccacauuccugacuucgauaaaagccugcgacaaggcaaucuguuacggcgccgaaucagugacccuaacgcggggucagaauacagucaaagugucuggcaaagggggacacaguggcuccaccuuuaagugcugucauggggaggauugcagccagauuggacugcacgcugccgcaccacaucucgacaaaguuaacggcaucucugaaguggagaauagcaaggucuaugaugacggugcuccgcaaugugggauuaaaugcugguucgugaaguccggagaauggaucucaggcauauuuagugguaacuggaucguucugauugugcuuugugucuucuugcuguucagcuuaguacuccugucuauccuuugcccugugcgaaaacacaagaaguccuga

SEQ ID NO: 10121 - RNA, 3408 nt, Artificial Sequence
  derived and/or modified CDS sequence (opt3) from HTNV(Aa14-175)__KU207163.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaaaagcuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaaguuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgaccugccaggguauuacgaggccauacaccccuguacagucuucugcgugcuuucuggaccgggcgcaucaugugaggcuuucagugaaggcgggauuuuuaacaucaccagcccuaugugccuggucuccaaacagaaucgguuccgcuugacggagcaacaggugaacuuuguuugucaaagaguggauguagacaucgucguguacugcaacggacagaggaagguuauucucaccaagacacuggugaucggucaguguauuuauacuauaaccucuuuauucucgcugcuccccggcgucgcccacagcaucgcgguggaacuuugcguaccaggguuucauggaugggccacagcagcucuguuggugacuuucuguuuuggcuggguucuaauuccugccaucaccuucaucauucugacaauacucaaauuuaucgcuaauauuuuccacaccuccaaccaagagaaucggcugaagucaguccuucgcaaaaucaaggaagaguuugagaaaacuaaggguaguauggugugcgauguguguaaguacgaaugcgagacguauaaagaacugaaggcccauggggucucuugcccccagagccaguguccauacugcuucacacacugugagcccaccgaagcagccuuucaggcucauuauaaaguuugccaagugacucaccgauucagagacgauuugaagaaaaccgugacaccucagaacuucaccccaggcuguuacaggacucucaaucuguuucgguauaagucccguugcuacauuuucacaauguggaucuuuuuacugguacuagagucaauacucugggcggcaagcgccucugagacgccgcugacccccgucuggaacgacaaugcucacggagugggcuccguuccuaugcauacugaucuugaauuggacuucagucugacaucuagcuccaaguacaccuaucgcagaaaacucacaaacccacuggaggaagcccagucaaucgaucuucacauugagaucgaggaacagacuauugggguggacguccaugcacugggacacugguuugaugguagguugaaucucaagaccaguuuccacuguuacggcgccugcacgaaauaugaguaccccuggcauaccgcuaagugucacuaugaacgggacuaccaauaugagacaagcugggggugcaacccuucggacuguccaggagugggcacugguugcaccgccugcgggcuguacuuagaucgacugaaacccguuggcuccgcauacaagaucauaacaauucgcuauucuagaaggguguguguacaguuuggagaagagaaucuaugcaagaucauugacaugaacgauuguuucgucagccggcaugugaaagugugcaucauaggcacugucucaaaguuuagucagggggacacccuccuguucuuuggaccgcuugaggguggcggguugaucuucaaacacugguguacguccacaugccaguuuggagauccuggcgacauuaugucuccacgcgauaaggguuuccugugucccgaguucccugggagcuuuagaaagaagugcaauuucgcgaccacucccaucugugaauacgacggcaacaugguuuccggauauaaaaaggugauggcuacaauugauucauuucagagcuucaauaccaguacuaugcauuuuaccgacgaaaggaucgaguggaaggauccagacggcaugcuccgugaucacauaaacauucugguaacaaaagacaucgacuucgauaacuuaggggaaaauccuugcaagaucggacugcagacgucuuccauugagggcgccugggguagcggggugggauuuacccuuacuuguuuggucucgcucacagagugccccaccuuccugacaucaaucaaagcaugcgacaaggccauuuguuacggcgcugaaucugugacucuaacccggggucagaacacgguuaaagugaguggcaaagggggacacuccggcagcacauuuaagugcugucauggggaggauugcucucagauaggacugcacgccgcagcuccacaucucgacaaggucaauggcaucagcgaaguggagaacuccaagguuuaugaugacggugccccgcaaugugggauuaaaugcugguucgugaagucaggagaauggaucaguggcauuuuuagcgguaauuggaucguccugauaguacuuuguguguucuugcuguucucuuuaguucuccuguccauccuuugcccugugcgaaaacacaagaagucauga

SEQ ID NO: 10122 - RNA, 3408 nt, Artificial Sequence
  derived and/or modified CDS sequence (opt3) from HTNV(Aa14-184)__KU207164.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugauugaggagucuuaucggagccgcaaguccaucaccuguuacgaucuuucaugcaauaacacuuauuguaaaccaacacuguacaugauuguacccauccaugcgugcaauaugaugaagaguuguuugauagcucucgggccuuaucgaguucagguggucuacgaacguaccuacugcaugacgggagugcugaucgagggcaaauguuucgugccagaccagagcgucguuucuauuaucaagcacgguauuuuugauaucgccuccgugcauauaguaugcuucuuuguggcagucaaagggaacacuuauaagauuuucgaacaggugaagaaaucauuugagagcaccuguaaugacacagagaacaagguucaaggauacuauaucugcauugugggcggcaauagugcccccaucuacgucccuacucuggaugacuucagaucuauggaagcauuuaccgggaucuucagguccccacacggagaggaucacgaccucgcuggugaagagacagccaccuauagcauugugggcccggcuaacgccaaaguaccccauucggcgucuuccgauacguuaucacugauagcauuuagugggaucccuagcuacuccucucuuagcauuuugacuucaaguacagaagccaagcacguuuucuccccaggacuguuucccaaacuaaaucauaccaacugcgacaagggcgcuaucccucucauguggacugguaugauagaccugccaggguauuacgaggccauucaccccuguacaguguucugcguccuuagcggaccgggcgcaucuugugaggcuuucucagaaggcgggaucuuuaauaucaccaguccuaugugccuggugagcaaacagaaccgguuccgcuugacggagcagcaggucaacuuugugugucaaagaguugauguggacauuguagucuacugcaauggacagaggaaggugauccucaccaagacacugguuauuggucaguguauauauacuaucaccuccuuauucucucugcuccccggcguggcccacucgauugcggucgaacuuugcgugccaggguuucauggaugggccacagcagcucuguugguaacuuucuguuuuggcugggugcuaaucccugccaucaccuucauuauacugacaauccucaaauuuauugcuaacaucuuccacaccagcaaucaagagaaccggcugaaguccguucuucgcaaaauuaaggaagaguuugagaaaacuaaggguucaauggucugcgauguguguaaguacgaaugcgagacguauaaagaacugaaggcccauggggugaguugcccccagucucaguguccauacugcuucacacacugugagcccaccgaagcagccuuucaggcucauuauaaagucugccaaguuacucaccgauucagagacgauuugaagaaaaccgugacaccucagaauuucaccccaggcuguuacaggacucucaaccuguuucgguauaagagccguugcuacaucuucacaauguggauauuuuuacuggugcuagaguccauccucugggcggcaucagccagcgagacgccgcugacccccguauggaaugacaacgcucacggagucggcucugugccuaugcauacugaucuugaauuggacuucucccugacaaguagcucuaaguacaccuaucgcagaaaacucacaaauccacuggaggaagcccaguccauugaucuucacaucgagauugaggaacagacuaucgggguugacgugcaugcacugggacacugguuugaugguagguugaaccucaagaccucauuccacuguuacggcgccugcacgaaauaugaguaccccuggcauaccgcuaagugucacuaugaacgggacuaccaauaugagacaaguugggggugcaauccuagcgacuguccaggagucggcacugguugcaccgccugcgggcuguacuuagaucgacugaaacccgugggcucggcauacaagauaauuacaauccgcuauuccagaaggguuugugugcaguuuggagaagagaaccuaugcaagauuaucgacaugaaugauuguuucguaucucggcaugucaaagugugcauaaucggcacugugagcaaguuuucacagggggacacccuccuguucuuuggaccgcuugaggguggcggguugauuuucaaacacugguguacgaguacaugccaguuuggagauccuggcgacaucauguccccacgcgauaaggguuuccugugucccgaguucccugggucuuuuagaaagaagugcaacuucgcgaccacucccauuugugaauacgacggcaauauggucagcggauauaaaaagguuauggcuacaaucgauuccuuucaaucauucaacaccagcacuaugcauuuuaccgacgaaaggauagaguggaaggauccagacggcaugcuccgugaucacauuaacauccuggugacaaaagacaucgacuucgauaauuuaggggaaaacccuugcaagauuggacugcagacgaguucuaucgagggcgccugggguuccgggguaggauuuacccuuacuuguuuggugagccucacagagugccccaccuuccugacaucgauuaaagcaugcgacaaggccauauguuacggcgcugaaucagucacucuaacccggggucagaauacggugaaaguuucuggcaaagggggacacaguggcuccacauuuaagugcugucauggggaggauugcagccagaucggacugcacgccgcagcuccacaucucgacaaagugaacggcauuucugaagucgagaauagcaagguguaugaugacggugccccgcaaugugggaucaaaugcugguucguuaaguccggagaauggauuucaggcaucuuuagugguaacuggauagugcugaucguccuuuguguauucuugcuguucagcuuagugcuccugucuauucuuugcccuguucgaaaacacaagaaguccuga

SEQ ID NO: 10123 - RNA, 3408 nt, Artificial Sequence
  derived and/or modified CDS sequence (opt3) from HTNV(LR1)__AF288293.1__GP
augggcaucuggaaguggcuggugauggccagccucgucuggcccguucuuacccugagaaacguguacgacaugaagauugagugcccucacacaguauccuucgggggaaauucugugauagguuaugucgaauugccaccggugcccuuagcugauacugcacagaugguuccugagucaaguuguagcauggacaaccaucaaucccugaauacgaucaccaaguacacacaggugucuuggaggggcaaagccgaucagucgcagucaagccaaaacaguuuugaaacugucuccaccgagguggaccuaaaggggacaugcguacucaaacacaagaugguugaagagucuuaucggagccgcaaguccgugaccuguuacgaucugucaugcaauaguacuuauuguaaaccaacacuuuacaugauuguccccauccaugcgugcaacaugaugaaaagcugucugauugcuuugggaccuuaucgaguccaggugguguacgagcguaccuacugcaugacgggcguucucaucgaagguaaguguuucgugccagaccagucuguaguguccauaaucaagcacgggauuuuugauaucgccucaguccauauugugugcuucuuuguugcagugaaaggaaauacuuauaagaucuucgagcaggucaagaaaaguuuugaaagcaccuguaacgacacagagaauaaggugcaaggcuacuauauaugcauuguaggcgggaacucugcccccaucuacguuccuacucuggaugacuucagauccauggaggcuuuuaccggaauuuucaggagcccacacggugaagaucgggaccuggcaggcgaggaaaucgccucguauucuaucguggggccggcuaaugccaaagucccccacuccgcgucaagugauacacuccgcuuaauugcauacagcggaauaccuuccuauucuagccugucaauccuuaccaguuccacggaggccaagcauguguuuagcccaggcuuguuccccaaacugaaccacacuaauugcgacaagucugcuauuccucuaaucuggacagguaugauagaccucccaggguacuacgaagccguccaucccuguaccguguuuugcguucugucaggaccgggcgcaaguugugaggcuuucagcgagggcgggauuuucaacaucacuuccucuaugugccuugugucgaaacagaauagauuuaggcugacagaacagcagguaaacuucgucugucaacggguggauauggacaucguuguguauugcaacggacagcgcaaggucauuuugaccaagacgcucgugaucggucaguguauuuacaccauaacaagccuguuuuccuuacugccuggcguagcccacucaaucgcgguggagcucugcguucccggguuccacggaugggccacugcagcccuucuggucaccuuucgauucggcuggguguugauuccagcuaucacauuuaucauucuaacugugcugaaauucauagcuaauaucuuucauaccaguaaccaagaaaauagacucaagucuguccugaggaaaauuaaggaggaauuugagaaaacaaaggguagcaugguuugugaugugugcaaguaugagugugaaaccuacaaagagcuuaaggcccacgggguguccugcccucagucacagugccccuauuguuucacucauugcgaaccaacggaggcagccuuccaggcucacuacaaaguaugucaagucacacaucgguuucgugacggccugaagaaaaccgugacuccccagaacuucaccccuggaugcuaucgcacauugaaucucuucagauacaagucuagguguuacaucuuuaccauguggauuuuccuguuaguucuggaaagcauccuaugggcggcauccgccagugagacuccacucacaccgguguggaacgauaaugcucacggcgucgggagcgugcccaugcacacggaccuggagcuugauuuuucuuugaccuccucaaguaaguauacuuaccggcgaaaacugacaaacccucucgaagaggcccagagcauagaccugcauaucgaaauugaggagcagaccaucggaguugaugugcacgcacuuggucauugguucgacggccgccugaauuugaagacaucguuucacugcuauggggccuguacuaaauacgaauauccauggcacaccgcuaagugccauuacgagagagauuaucaauacgaaacguccuggggauguaaccccucugacugcccuggcguagguaccggguguacagccugcggccucuaccuggaccaguuaaaaccagucggaagcgcauauaagauuaucacuauaagguacucacggcgcgugugcgugcaguucggcgaggaaaaucuguguaagauuaucgauaugaacgacugcuuugucaguagacacguuaaaguguguauuaucgggaccguauccaaguucucucagggagauacacuacucuuuuucgguccccuggagggcgggggacuuauauuuaaacauuggugcacuagcaccugucaauucggcgacccgggugauaucauguccccuagggacaagggguuuuugugcccagaguuccccggcucauuccguaaaaaguguaauuuugcgacgacaccuauuugcgaauaugauggaaacauggugagcggcuacaaaaaggucauggcuaccaucgacaguuuccagucuuuuaauacuuccacaaugcacuucaccgaugagcggauugaauggaaggaccccgaugggaugcugcgagaccauaucaacauacucgugacuaaagauauugacuuugacaaccugggagagaauccauguaagaucggcuuacagaccagcucgaucgaaggugccugggggucaggaguuggcuucacacugacgugccuugugucuuugaccgaguguccuacuuuucucacaaguauuaaagcaugcgauaaggccaucugcuauggugcugaguccggcacccugacaagagggcagaacacugucaaagugagcggaaagggcgggcacucuggaagcaccuucaaguguugccacggcgaagacuguucccaaauuggucuacaugccgcagcuccccaccuggauaaaguuaaugggauaucagagaucgaaaacaguaagguguacgacgauggagccccacagugcggcauuaaauguugguuugucaagagcggugaguggaucucuggcauuuucuccgggaauuggaucguacucauagugcugugcguuuuucuuuuguucucacugguguuacucaguaucccguguccugucaggaaacauaaaaagagcuga

SEQ ID NO: 10124 - RNA, 3408 nt, Artificial Sequence
  derived and/or modified CDS sequence (opt3) from HTNV(SN7)__AF288656.1__GP
augggcguguggaaguggcuggucauggccagccucguuuggcccgcuugcacccuuagaaacguguacgacaugaaaaucgaguguccucacacaguauccuucggggaaaauucugugauuggauaugucgagcugccaccgaugcccuuggcagauacuacgcaguuagugccugaaucaaguugcagcauggacaaccaucaaucccugaauaccauaacaaaguacacucagguuucuuggaggaaaaaggccgaucaggcgcagucgucacaaaacagcuuugagaccgugagugucgaaguggaccuaaaagguacauguguacucaagcacaagaugaucgaggaguccuaucggucucgcaaaagcauuaccugcuacgaucuguccuguaauucaacuuauugcaagccaacacuuuacaugaucguucccauucaugcuuguaacaugaugaaaaguugccugaucgccuugggcccuuaucgagugcaggucguguacgaacguaccuacuguaugacgggggugcucauagagggaaagugcuucgucccagaccagagcguugugucuaucauuaaacacggcaucuuugauauugcauccguaaagaucguguguuucuuugucgccgugaagagaaauacuuauaaacuguucgaacagguuaagaaaucauuugacucgaccugcaacgauacagagaauaaggugcaagguuacuauauaugcauugucgggggaaacagugcucccaucuacgugccuacucuggacgauuucaggucuauggaggcauuuuccggcauuuuccggagcccacauggcgaagaccacgaucucgccggggaggaaguagcuucguauucuaucguuggaccggccaaugcgaaagugccccacuccgcaucaagugacaccuuaagccugaucgccuacuccgguauuccuucuuauagcucacuuaguauauugacauccagcaccgaggcuaagcaugucuuuucuccaggcuucuuuccccagcugaaccacacgaaaugugacaagacugccaucccucuaacauggaccgggaugauugaucucccaggauacuacgaagcaauccaucccugcacuguguucuguguccugucaggcccgggugcuaguugcgaggccuucagcgagggaggaauauuuaauauuacauccccuaugugucuugugucuaagcagaaccgcuucagacugaccgaacagcaaguuaauuuugugugccagaggguagacauggauaucgucguguauuguaacggccagcggaaaguuaucuugacgaagaccauggugauuggccaaugcaucuacacaauuacuagccucuucagccuguuacccggggucgcgcacuccauagccguggagcuguguguaccaggauuucacgguugggcaaccgcugcccuccuugugacauucugcuuuggcuggguucugaucccugcugucacuuucauuaucuugaccgugcuaaaauuuguggccaacaucuuccauacaucaaaucaggaaaaccgccugaagaguguccuccgaaaaauuaaggaggaauuugagaagaccaaagggucuaugguuugugacgugugcaaguaugagugcgaaacuuacaaagagcugaaggcacacggagugagcuguccccagucccagugcccauauuguuucacgcauugcgaacccacagaggccgcuuuucaagcgcacuacagaguaugucaggucacccauagguuccgggaugaccuuaaaaagacugugaccccucagaauuucacaccaggcugcuaucguacccugaacuuguuucgcuacaagucaagauguuacauauucacuauguggguuuuucuccugguguuagaaagcauccugugggcagccucugcuuccgaggucccgcuaaaucccauuuggaacgauaaugcccacgguguggggaguguuccuaugcacacagaccucgagcuggauuucagccuuacgucuuccucaaaauauaccuacaggcggaaguugacuaacccacuggaagagacacaggcaaucgaccuccauauugaaaucgaggagcaaaccauaggcguggauguacacgcccugggacauugguuugacggccgacuuaaucugaaaacaaguuuccacugcuauggggcuuguacuaaguacgaauaucccuggcacaccgccaaaugccauuacgagcgcgacuaucaguacgaaacgagcuggggauguaacccuucggauugcccaggugucggcaccgggugcacagcauguggauuguaccucgaccagcugaagcccgugggcuccgcguauaagaucauuacuaucagauacucuaggcgggugugcguccaguuuggugaggaaaauuuauguaaaguuauugauaugaacgacugcuucgugagccgccacguaaagguguguaucauagggaccgucucaaaauuuagucaaggcgauacacugcuauucuuuggaccgcucgagggcgggggacugauuuucaagcauuggugcacuuccaccugucaguuuggugacccuggcgauaucaugucuccaagagacaaaggguuccuuugccccgaguucccugggagcuuuaggaagaaauguaauuucgcuacgacacccuugugcgaauaugauggcaacaugauuuccgguuacaagaaggugauggccaccaucgacucauuucagagcuucaauacaaguacuaugcacuuuaccgaugagcguauagaauggaaagacccagaugggaugcugcgggaccauaucaacauucucguuacuaaggacaucgauuucgacaaccugggcgagaauccuuguaaaauuggauuacagaccucuuccaucgaaggcgcaugggggagcggagugggcuuuacacugacgugccuugucucguugaccgagugccccacuuuccucacaucaauaaaggccugugauaaagcuauuugcuauggugccgagucugugacccugacacgagggcaaaacacuguuaaggugaguggaaagggcggucacuccggcagcaccuuuaaauguugccacggggaagacuguucucagacgggacuacaugcagcugccccacaccuggauaaggucaauggcaucagcgaguccgaaaacucaaaaguauacgacgauggggcgccgcagugcggaaucaaguguugguucgugaaaaguggcgaguggauuagcgguaucuuuucugggaauuggauuguucucauagugcugugcgucuuccuuuuguucucccugguguuacucucaguacuguguccugugagaaagcauaagaaaaguuga

SEQ ID NO: 10125 - RNA, 3408 nt, Artificial Sequence
  derived and/or modified CDS sequence (opt3) from HTNV(84FLi)__AF366569.1__GP
augggcguguggaaguggcuggucauggccagccucguuuggcccgcuugcacccuuagaaacguguacgacaugaaaaucgaguguccucacacaguauccuucggggaaaauucugugauuggauaugucgagcugccaccgaugcccuuggcagauacuacgcaguuagugccugaaucaaguugcagcauggacaaccaucaaucccugaauaccauaacaaaguacacucagguuucuuggaggaaaaaggccgaucaggcgcagucgucacaaaacagcuuugagaccgugagugucgaaguggaccuaaaagguacauguguacucaagcacaagaugaucgaggaguccuaucggucucgcaaaagcauuaccugcuacgaucuguccuguaauucaacuuauugcaagccaacacuuuacaugaucguucccauucaugcuuguaacaugaugaaaaguugccugaucgccuugggcccuuaucgagugcaggucguguacgaacguaccuacuguaugacgggggugcucauagagggaaagugcuucgucccagaccagagcguugugucuaucauuaaacacggcaucuuugauauugcauccguaaagaucguguguuucuuugucgccgugaaggguaauacuuauaaacuguucgaacagguuaagaaaucauuugacaguaccugcaacgauacagagaauaaggugcaaggguacuauauaugcauugucggaggcaacagugcucccaucuacgugccuacucuggacgauuucagaucuauggaggcauuuuccggcauuuucaggagcccacauggggaagaccacgaucucgccggagaggaaguagcuucguauucuaucguugguccggccaaugcgaaagugccccacaacgcauccucagacaccuuaagucugaucgccuacagcggcauuccuuccuauucuagccuuucaauauugacaaguuccaccgaggcuaagcaugucuuuagcccaggguucuuuccccagcugaaucacacgaaaugugacaagacugccaucccucuaacauggaccggaaugauugaucucccaggcuacuacgaagcaauccaucccugcacuguguucuguguccugucugguccgggggcuucaugcgaggccuucagugagggaggcauauuuaacauuacaagcccuaugugucuuguguccaagcagaaucgguuccgccugaccaaacagcaaguuaacuuugugugccagagaguagacauggauaucgucguguauuguaacggccagaggaagguuaucuugacgaaaaccauggugauugggcaaugcaucuacacaauuacuucucucuucucgcuguuacccggagucgcgcacagcauagccguggaacuguguguaccagguuuucacggcugggcaaccgcugcccuccuugugacauucugcuuuggguggguucugaucccugcugucacuuucauuaucuugaccgugcuaaaguuuguggccaauaucuuccauacauccaaccaggagaaucggcugaaaucaguccuccgcaagauuaaggaagaguuugagaaaaccaagggaaguaugguuugugacgugugcaaauaugagugcgagacuuacaaggaacugaaagcacacggcgugucuuguccccagagccagugcccauauuguuucacgcauugcgagcccacagaagccgcuuuucaagcgcacuaccgaguaugucaggucacccauagauucagggaugaccuuaagaagacugugaccccucagaacuucacaccagguugcuaucggacccugaauuuguuucguuacaaaucccgcuguuacauauucacuauguggguuuuucuccugguguuagagucaauccugugggcagccagcgcuucugaagucccgcuaaaccccauuuggaaugauaacgcccacggggugggcuccguuccuaugcacacagaccucgagcuggauuucagucuuacgucuagcuccaaguauaccuacagaaggaaauugacuaauccacuggaggaaacacaggcaaucgaccuccauauugagaucgaagaacaaaccauaggaguggauguacacgcccugggccauugguuugacgggcggcuuaaccugaagacaucauuccacugcuauggagcuuguacuaaauacgaguaucccuggcacaccgccaagugccauuacgaacgagacuaucaguacgagacgaguugggguuguaauccuagcgauugcccaggcgucgggaccggaugcacagcauguggcuuguaccucgaccagcugaagcccguggguucggcguauaaaaucauuacuauccgcuacuccagaagggugugcguccaguuuggggaagagaacuuauguaagguuauugauaugaaugacugcuucgugucucggcacguaaaaguguguaucauaggcaccgucagcaaguuuucacaaggagauacacugcuauucuuuggcccgcucgaagggggaggucugauuuucaaacauuggugcacuagcaccugucaguuuggcgacccuggggauaucauguccccacgcgacaagggauuccuuugccccgaguucccuggcucuuuuaggaaaaaguguaacuucgcuacgacacccuugugcgaguaugaugguaauaugauuagcggguacaagaaagugauggccaccaucgacuccuuucagucauucaacacuagcacaaugcacuuuaccgaugaaagaauagaguggaaggacccagauggcaugcugcgugaccauaucaacauucucguuacuaaagacaucgauuucgacaaucugggagaaaacccuuguaagauuggcuuacagaccaguucuaucgagggggcauggggauccggcguggguuuuacacugacgugccuugucagcuugaccgaaugccccacuuuccucacaucgauaaaagccugugauaaggcuauuugcuauggggccgagucagugacccugacacggggacaaaauacuguuaaggugucuggcaaagguggccacaguggguccaccuuuaaguguugccacggagaggacuguagccagacgggccuacaugcagcugccccacaccuggauaaagucaacgggaucucugaaaucgagaauagcaagguauacgacgauggagcgccgcagugcggcauuaaauguugguucgugaaguccggugaauggaucucagggauuuuuaguggaaacuggauaguucucaucgugcugugcgucuuccuuuuguucagccugguguuacucucuguacuguguccugugcgaaagcauaaaaaguccuga

SEQ ID NO: 10126 - RNA, 3408 nt, Artificial Sequence
  derived and/or modified CDS sequence (opt3) from HTNV(Aa08-1111)__KY594715.1__GP
augggcaucuggaaguggcuggugauggccagccucgucuggcccguuuucacccuuagaaacguguacgacaugaaaauugagugcccucacacaguauccuuuggggaaaauucugugauaggauaugucgagcugccaccgaugcccuuggcugauacugcacagauggugccugaaucaaguuguagcauggacaaccaucaauccuuaaauacgaucaccaaguacacacagguuucuuggagggguaaagccgaucagucgcagucaagccaaaacaguuucgagacuguguccaccgaagucgaccugaagggcacaugcgugcuaaaacacaagaugguagaggagucuuaucggagccgcaaguccauuaccuguuacgaucucucaugcaauaguacuuauuguaaaccaacacuguacaugaucguucccauucaugcgugcaacaugaugaaaagcugucuuaucgcucuggggccuuaucgagugcaggucguguacgaacguaccuacugcaugacgggaguguugauagagggcaaguguuuugucccagaccagucuguuguguccaucauuaagcacgguaucuucgauauugccucaguacauaucgugugcuuuuucgucgcagugaaagggaauacuuauaagauauuugaacagguuaagaaaaguuucgagagcaccuguaacgacacagagaauaaggugcaaggauacuauauuugcaucgucggcggcaacucugcccccauuuacgcuccuacucucgaugacuuuagauccauggaagcauucaccgggaucuuuaggagcccacacggagaggaucacgaccuggccggugaagagaucgcuucguauucuauugugggcccggccaaugcgaaaguaccccauuccgcaucaagugauacacugagccucauagccuacuccgggaucccuucuuauagcucauuaaguauuaucaccuccagcacggaagcuaagcacguuuucucuccaggacuguuucccaaacuuaaccauacuaauugcaacaagggcgccauaccuuugauuuggacagguaugaucgaccugccaggguacuacgaggcagugcaccccuguaccgucuucugcgugcuaucaggaccgggcgcuaguugugaggccuucagcgaaggcgggaucuuuaauauuacuuccccuaugugccucgucucuaaacagaaccgguuccgccugacagagcaacaggugaacuuuguuugucagagaguggacauggauaucguagucuauugcaauggacagaggaaggugauucuuaccaagacgcugguuauaggucaguguaucuacaccauuacaucguuguucagccuccugcccggcguggcgcacuccaucgccgucgaauuaugcgugccaggguuucauggaugggcaacugcugcccugcucguaaccuucuguuuuggcugggugcuuaucccugcuauuacauucauaauccugacuguuuugaaauuuauugccaacaucuuccacaccucaaaucaagagaaccggcuaaagaguguccugcgcaaaauuaaggaagaguuugagaaaacaaaggguucuauggugugcgacaucuguaaguaugaaugcgagaccuacaaagaacucaaggcacauggggugagcugcccccagucccaguguccauauugcuucacucacugugagcccacggaagccgcuuuucaggcgcauuacaaagucugccaaguuacacaccgauucagagaugaccugaagaaaaccgugacuccucagaauuucaccccaggcuguuauaggacacuuaaccuguuucgguacaagucacguugcuacauauucaccauguggaucuuuuugcucgugcuggagagcauuuuaugggcagccucugcuuccgagacuccgcugacacccguauggaaugauaacgcccacggagucggcagugugccuaugcauacggaccuagaacucgauuucagccugaccucuuccucaaaguauacuuaccgcagaaaacuuacaaauccauuggaggaagcacagaguaucgggcugcacauugagaucgaggaacagaccauaggaguugacgugcaugcccucggucacugguuugauggcaggcugaaccuuaagacuagcuuccacuguuauggggcuugcacaaaauacgaguaucccuggcauaccgccaagugucacuacgaacgggacuaucaauacgagacgucguggggaugcaauccuuccgauuguccaggcgucgguaccgggugcacagcaugcggccuguacuuggaccagcucaaacccgugggaucugcguauaagauuaucacuauucgauacagccgcagaguuugugugcaguuuggcgaagaacaucugugcaagaucauagacaugaacgauuguuucguaucaaggcacgucaaagugugcaucauugggaccgugaguaaguuuucccagggagacacauuacuguucuuugguccgcuagagggcgggggacucaucuucaaacauugguguacuucuaccugccaauuuggcgauccuggugacauuaugagcccacgggauaagggguuccugugucccgaguucccuggcuccuuucgcaaaaagugcaauuucgcuacgacacccaucugugaguaugacggaaacauggucucaggcuacaaaaagguuauggccaccauagauagcuuucagaguuucaauacuucuacaaugcacuuuaccgacgaaagaauugaguggaaggauccagacgggaugcuuagggaucacaucaacaucuuggugacuaaagacauugauuucgacaaccugggagaaaauccuugcaagaucggccuccagaccuccagcauugagggugcaugggggucgggaguaggcuuuacacugacguguuuagugucacugaccgagugccccacuuuccuuacaucuauaaaagccugcgacaaggcuaucuguuauggugccgaaagugucaccuugacacguggccagaacacugugaaaguuuccgggaagggaggccauagcgggucuaccuuuaagugcugucacggagaggaaugcagccaaauuggccuccaugcagcugccccacaccuggauaaagugaaugguaucuccgagauugaaaacucaaaggucuacgacgauggggcgccgcaguguggaaucaaaugcugguucgugaagaguggcgaguggauaagcgguaucuuuucuggcaauuggauuguucuaaucgugcugugugucuuccuccuguucucccuuguauugcugucaauuuuaugcccugugcggaaacauaagaagaguuga

SEQ ID NO: 10127 - RNA, 3408 nt, Artificial Sequence
  derived and/or modified CDS sequence (opt3) from HTNV(Aa09-189)__KY594716.1__GP
augggcaucuggaaguggcuggugauggccagccucgucuggcccguuuucacccuuagaaacguguacgacaugaaaauugagugcccucacacaguauccuuuggggaaaauucugugauaggauaugucgagcugccaccgaugcccuuggcugauacugcacagauggugccugaaucaaguuguagcauggacaaccaucaauccuuaaauacgaucaccaaguacacacagguuucuuggagggguaaagccgaucagucgcagucaagccaaaacaguuucgagacuguguccaccgaagucgaccugaagggcacaugcgugcuaaaacacaagaugguagaggagucuuaucggagccgcaaguccauuaccuguuacgaucucucaugcaauaguacuuauuguaaaccaacacuguacaugaucguucccauucaugcgugcaacaugaugaaaagcugucuuaucgcucuggggccuuaucgagugcaggucguguacgaacguaccuacugcaugacgggaguguugauagagggcaaguguuuugucccagaccagucuguuguguccaucauuaagcacgguaucuucgauauugccucaguacauaucgugugcuuuuucgucgcagugaaagggaauacuuauaagauauuugaacagguuaagaaaaguuucgagagcaccuguaacgacacagagaauaaggugcaaggauacuauauuugcaucgucggcggcaacucugcccccauuuacgcuccuacucucgaugacuuuagauccauggaagcauucaccgggaucuuuaggagcccacacggagaggaucacgaccuggccggugaagagaucgcuucguauucuauugugggcccggccaaugcgaaaguaccccauuccgcaucaagugauacacugagccucauagccuacuccgggaucccuucuuauagcucauuaaguauuaucaccuccagcacggaagcuaagcacguuuucucuccaggacuguuucccaaacuuaaccauacuaauugcgacaagggcgccauaccuuugauuuggacagguaugaucgaccugccaggguacuacgaggcagugcaccccuguaccgucuucugcgugcuaucaggaccgggcgcuaguugugaggccuucagcgaaggcgggaucuuuaacauuacuuccccuaugugccucgucucuaaacagaaucgguuccgccugacagagcaacaggugaacuuuguuugucagagaguggauauggacaucguagucuauugcaacggacagaggaaggugauucuuaccaagacgcugguuauaggucaguguaucuacaccauuacaucguuguucagccuccugcccggcguggcgcacuccaucgccgucgaauuaugcgugccaggguuucauggaugggcaacugcugcccugcucguaaccuucuguuuuggcugggugcuuaucccugcuauuacauucauaauccugacuguuuugaaauuuauugccaauaucuuccacaccucaaaccaagagaaucggcuaaagaguguccugcgcaaaauuaaggaagaguuugagaaaacaaaggguucuauggugugcgauaucuguaaguaugaaugcgagaccuacaaagaacucaaggcacauggggugagcugcccccagucccaguguccauauugcuucacucacugugagcccacggaagccgcuuuucaggcgcauuacaaagucugccaaguuacacaccgauucagagacgaucugaagaaaaccgugacuccucagaacuucaccccaggcuguuauaggacacuuaaucuguuucgguacaagucacguugcuacauauucaccauguggaucuuuuugcucgugcuggagagcauuuuaugggcagccucugcuuccgagacuccgcugacacccguauggaacgacaaugcccacggagucggcagugugccuaugcauacggaucuagaacucgacuucagccugaccucuuccucaaaguauacuuaccgcagaaaacuuacaaacccauuggaggaagcacagaguaucgggcugcacauugagaucgaggaacagaccauaggaguugaugugcaugcccucggucacugguuugacggcaggcugaaucuuaagacuagcuuccacuguuauggggcuugcacaaaauacgaguaucccuggcauaccgccaagugucacuacgaacgggauuaucaauacgagacgucguggggaugcaacccuuccgacuguccaggcgucgguaccgggugcacagcaugcggccuguacuuggaccagcucaaacccgugggaucugcguauaagauuaucacuauucgauacagccgcagaguuugugugcaguuuggcgaagaacaucugugcaagaucauagauaugaaugacuguuucguaucaaggcacgucaaagugugcaucauugggaccgugaguaaguuuucccagggagauacauuacuguucuuugguccgcuagagggcgggggacucaucuucaaacauugguguacuucuaccugccaauuuggcgacccuggugauauuaugagcccacgggacaagggguuccugugucccgaguucccuggcuccuuucgcaaaaagugcaacuucgcuacgacacccaucugugaguaugauggaaauauggucucaggcuacaaaaagguuauggccaccauagacagcuuucagaguuucaacacuucuacaaugcacuuuaccgaugaaagaauugaguggaaggacccagaugggaugcuuagggaccacaucaauaucuuggugacuaaagauauugacuucgacaaccugggagaaaacccuugcaagaucggccuccagaccuccagcauugagggugcaugggggucgggaguaggcuuuacacugacguguuuagugucacugaccgagugccccacuuuccuuacaucuauaaaagccugcgauaaggcuaucuguuauggugccgaaagugucaccuugacacguggccagaauacugugaaaguuuccgggaagggaggccauagcgggucuaccuuuaagugcugucacggagaggaaugcagccaaauuggccuccaugcagcugccccacaccuggacaaagugaacgguaucuccgagauugaaaauucaaaggucuacgaugacggggcgccgcaguguggaaucaaaugcugguucgugaagaguggcgaguggauaagcgguaucuuuucuggcaacuggauuguucuaaucgugcugugugucuuccuccuguucucccuuguauugcugucaauuuuaugcccugugcggaaacauaagaagaguuga

SEQ ID NO: 10128 - RNA, 3408 nt, Artificial Sequence
  derived and/or modified CDS sequence (opt3) from HTNV(CJilin93)__AY748307.1__GP
augggcauguggaaguggcuggugaucgccagccucgucuggcccgcucuugcacugagaaacguuuacgacaugaaaauugagugcccucacaccguguccuucggggaaaauucuguaauaggauauguggaguugccaccgaugcccuuagccgauacagcgcagauggucccugaaucaaguuguagcauggacaaccaucaauccaucaauacuauuacgaaguacacccaggugacauggagggguaaagcugauccaggccagucuucgcagaacucauuugagacucugagcgccgaaguugaccuaaaggggaccugcgugcucaaacacaagauggucgaggagaguuaucggucccgcaagucuaucacauguuacgaucugagcugcaauuccaccuauuguaaacccacucuuuacaugauugugccuauccaugcaugcaacaugaugaagucaugucugauagccuugggaccauaucgaguacaaguuguguacgaacguacauacugcaugaccggcguccucaucgaggguaaauguuucgugcccgaccagaguguggucagcauuaucaagcacgggauuuuugauaucgcuucuguucauauagugugcuucuuuguagcagugaaaggaaauacguauaagcuguucgaacaggucaagaaauccuuugagucaacuuguaacgacaccgagaauaaggugcagggcuacuauauuugcaucguuggcgggaacagcgccccuauuuacgugccaacacuggaugacuucagaaguauggaggcuuuuacuggaaucuucaaaucuccgcacggugaagaucacgaccucgccggcgaagagaucgcguccuauagcauugucgggcccgcaaaugccaaggugccucauucggcuucuuccgauaccuuaucacugauagccuacaguggaaucccaagcuauuccucucuuagcauuuugacaucaaguaccgacgcaaaacacguauuuucccccggccuguucccuaagcuaaaccauacgaauugcgacaaaagcgcuaucccacucacuuggacagguaugauagaucugcccggguacuacgaagccauucacccguguaccguguuuugcguucuuucuggaccuggcgcgucaugugaggccuucagugagggcgggaucuucaacaucacuagccccaugugccuggucuccaagcaaaauagguuucgguugacagaacaacaggugaacuucgucugucagcgcguggacauggauauuguuguguauugcaacggacaaagaaagguaauccucaccaaaacgcuggucauuggucaguguauauacaccaucacaucuuuauuuucgcugcucccaggcguggcacacagcauugcuguugagcuuugcgugccuggguuccauggaugggccacugcugcccuguuggucaccuauuguuuuggcugggugcuaauccccgcaaucacauucauuauacugacuguacucaaguuuaucgccaauauuuuccacaccuccaaccaggaaaauaggcugaaaucagugcuucggaagaucaaagaggaauuugagaagacaaaggguaguaugguuugcgacgucuguaaauacgagugcgaaaccuauaaggagcugaaagcucauggggugucuugcccacaaagccagugucccuacugcuucacucacugugaaccuacggaggcggcauuucaggcccauuauaaggugugccaggucacacaccgcuuccgagaugacuugaaaaagaccguuacuccacaaaacuuuaccccgggcuguuacagaacacucaaucuguucagguacaagucccggugcuauauuuucaccauguggguguuuuuacugauccuagaaucagugcucugggcugccagcgcaucugagacuccccugacaccuguauggaacgauaaugcccacggagucggcuccgugccaaugcauacggaccuugaguuggauuucagucugaccaguucuuccaaauacacuuaucgucgcaagcucacaaacccccuggaagaggcucagucaauagaccuucacaucgaaauugaggagcagaccaucgggguugaugugcaugcccugggacacugguuugacgguagauugaauauuaaaacaaguuuccacuguuacggcgcaugcacuaaguaugaauacccuuggcauaccgcgaaaugucacuaugagagggacuaccaguacgaaacgagcugggggugcaacccaucggauugucccggagucggcaccgguugcacagcuugcgggcucuaucuggaccaauuaaagccggugggcuccgccuacaagaucauaacuauucgguauucucgacgcguuugugugcaguuuggagaggaaaaucugugcaaaaucauugauaugaacgacuguuucguaagcagacaugucaaggugugcaucauaggcaccgugucaaaauuuagucagggggauacacuacucuucuuuggaccucuggaggguggcgggcuuaucuucaagcacugguguacuucuaccugccaguuuggagacccaggcgauauuaugucccccagggacaaagguuucuuguguccugaguuucccgggagcuuccggaagaaaugcaauuucgcaacgacaccaaucugugaauacgauggcaacauggucuccggauauaagaagguuauggccaccauugacucauuucagagcuucaauacuagcacaaugcauuuuaccgaugagcgcaucgaauggaaagacccugauggcaugcugagagaccacauaaacauucucgugacuaaggacaucgauuucgacaaccugggggagaaucccugcaaaaucggauuacagaccucuuccauugaaggcgcuugggguagcgggguaggauuuacacugacgugucuugugucguugaccgagugcccaacuuuccucacaucaaucaaggccugcgauaaagcaauuuguuacggcgcugagucugucacccugacaaggggucagaacacugugaagguuaguggcaaagggggacacuccggcagcaccuuuaagugcugucauggggaagacugcucuaagauaggacuacacgccgcggccccgcaucuggauaaagugaauggcaucagcgagauugaaaacuccaaggucuaugacgauggugcuccucagugugggaucaaaugcugguucgugaagucaggagaguggauuaguggcaucuuuagcgguaauuggauaguucucaucgugcugugugucuuccuuuuguuuucucugguauuacucuccauucugugccccgugcguaagcacaaaaagucauga

SEQ ID NO: 10129 - RNA, 3408 nt, Artificial Sequence
  derived and/or modified CDS sequence (opt3) from HTNV(KHF,clone:4)__LC209208.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaaaagcuguuugaucgcucucgggccuuaucgagugcaggucguguacgaacguaccuacugcaugacgggagugcugauagagggcaaguguuucgucccagaccagucuguuguguccaucauuaagcacgguaucuuugauauugccucaguacauaucgugugcuucuuugucgcagugaaagggaauacuuauaagauauucgaacagguuaagaaaaguuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgaccugccaggguauuacgaggccauacaccccuguacagucuucugcgugcuuucuggaccgggcgcaucaugugaggcuuucagugaaggcgggauuuuuaacaucaccagcccuaugugccuggucuccaaacagaaucgguuccgcuugacgaagcaacaggugaacuuuguuugucaaagaguggauguagacaucgucguguacugcaacggacagaggaagguuauucucaccaaaacacuggugaucggucaguguauuuauacuauaaccucuuuauucucgcugcuccccggcgucgcccacagcaucgcgguggagcuuugcguaccaggguuucauggaugggccacagcagcucuguuggugacuuucuguuuuggcuggguucuaauuccugccgucaccuucaucauccuggcuauucucaaguuuauagccaauaucuuccacacauccaaccaagaaaaucggcugaaaucagugcuucgcaagauuaaagaggaauuugagaagaccaaggguaguauggugugcgaugucuguaaauacgagugcgaaacuuauaaggagcugaaagcacaugggguuucuugcccccagagccaguguccauacugcuucacgcacugugaacccacagaggccgcuuuucaggcgcauuauaaggugugccaagugacccaccgauucagagacgauuugaaaaagacuguaaccccucagaacuucacaccaggcuguuacaggacccucaaucuguuucgguauaagucccguugcuacaucuucacuauguggaucuuuuuacugguccuagaaucaauucucugggcagccagcgcuucugagacaccgcugacgcccguguggaacgacaaugcccacggaguuggcuccauaccuaugcauaccgaucuugaguuggacuucagucugacuagcaguuccaaauacacauaucgcagaaagcucaccaacccacuggaagaggcacagucaaucgaucuucacauugaaaucgaggagcagacaauugggguggacguccaugcccugggacacugguuugaugguagguugaaucucaaaacuucuuuccacuguuacggcgcuugcaccaaguaugaauaccccuggcauacggccaaaugucacuaugagcgggacuaccaauaugaaaccagcugggggugcaacccuucggacuguccaggagugggcacagguugcacugcaugcgggcuguacuuagaucgacugaagcccguuggcuccgcguacaagaucauaaccauucgcuauucuagaaggguguguguacaguuuggagaggaaaaucuaugcaaaaucauugacaugaacgauuguuucgucagccggcaugugaaggugugcaucauaggcacagucucaaaauuuagucagggggacacucuccuguucuuuggaccgcuugaggguggcggguugaucuucaagcacugguguaccuccacgugccaguuuggagauccuggcgacauuaugucuccacgcgauaaagguuuccugugucccgaguucccugggagcuuuagaaagaaaugcaauuucgcuacaacccccaucugugaauacgacggcaacaugguuuccggauauaagaaggugauggccacuauugauucauuucagagcuucaauacaaguaccaugcauuuuacugacgagaggaucgaauggaaagauccagacggcaugcuccgugaucacauaaacauucugguaaccaaggacaucgacuucgauaacuuaggggagaauccuugcaaaaucggacugcagacaucuuccauugaaggcgcaugggguagcggggugggauuuacgcuuaccuguuuggucucgcucacugagugccccacauuccugaccucaaucaaggccugcgacaaagcuauuuguuacggcgccgagucugugacacuaacucggggucagaacaccguuaaggugaguggcaaagggggacacuccggcagcacguuuaagugcugucauggggaagauugcucuccaaauggacugcacgcagcugccccgcaucucgacaaggucaacggcauaagcgagaucgaaaauuccaaaguguaugaugacggugcgccucagugugggauuaagugcugguucguuaaaucaggagaguggaucaguggcauuuuuagcgguaacuggaucgugcugauaguccuuuguguauucuugcuguucucuuuagugcuccuguccauccuuugccccguucgaaagcacaagaaaucauga

SEQ ID NO: 10130 - RNA, 3408 nt, Artificial Sequence
  derived and/or modified CDS sequence (opt3) from HTNV(KHF,clone:5)__LC209209.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaaaagcuguuugaucgcucucgggccuuaucgagugcaggucguguacgaacguaccuacugcaugacgggagugcugauagagggcaaauguuucgucccagaccagucuguuguguccaucauuaagcacgguaucuuugauauugccucaguacauaucgugugcuucuuugucgcagugaaagggaauacuuauaagauauucgaacagguuaagaaaaguuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgaccugccaggguauuacgaggccauacaccccuguacagucuucugcgugcuuucuggaccgggcgcaucaugugaggcuuucagugaaggcgggauuuuuaacaucaccagcccuaugugccuggucuccaaacagaaucgguuccgcuugacggagcaacaggugaacuuuguuugucaaagaguggauguagacaucgucguguacugcaacggacagaggaagguuauucucaccaagacacuggugaucggucaguguauuuauacuauaaccucuuuauucucgcugcuccccggcgucgcccacagcaucgcgguggaacuuugcguaccaggguuucauggaugggccacagcagcucuguuggugacuuucuguuuuggcuggguucuaauuccugccgucaccuucaucauccuggcuauucucaaauuuauagccaauaucuuccacacauccaaccaagagaaucggcugaagucagugcuucgcaaaauuaaggaagaguuugagaaaaccaaggguaguauggugugcgaugucuguaaguacgaaugcgagacuuauaaagaacugaaggcacaugggguuucuugcccccagagccaguguccauacugcuucacgcacugugagcccacagaagccgcuuuucaggcgcauuauaaagugugccaagugacccaccgauucagagacgauuugaagaaaacuguaaccccucagaacuucacaccaggcuguuacaggacccucaaucuguuucgguauaagucccguugcuacaucuucacuauguggaucuuuuuacugguccuagagucaauucucugggcagccagcgcuucugagacaccgcugacgcccguguggaacgacaaugcccacggaguuggcuccauaccuaugcauaccgaucuugaauuggacuucagucugacuucuagcuccaaguacacauaucgcagaaaacucaccaacccacuggaggaagcacagucaaucgaucuucacauugagaucgaggaacagacaauugggguggacguccaugcccugggacacugguuugaugguagguugaaucucaagaccaguuuccacuguuacggcgcuugcacuaaauaugaguaccccuggcauacggccaagugucacuaugaacgggacuaccaauaugagaccagcugggggugcaacccuucggacuguccaggagugggcacagguugcacugcaugcgggcuguacuuagaucgacugaaacccguuggcuccgcguacaagaucauaaccauucgcuauucuagaaggguguguguacaguuuggagaagagaaucuaugcaagaucauugacaugaacgauuguuucgucagccggcaugugaaagugugcaucauaggcacagucucaaaguuuagucagggggacacucuccuguucuuuggaccgcuugaggguggcggguugaucuucaaacacugguguaccuccacgugccaguuuggagauccuggcgacauuaugucuccacgcgauaaggguuuccugugucccgaguucccugggagcuuuagaaagaagugcaauuucgcuacaacccccaucugugaguacgacggcaacaugguuuccggauauaaaaaggugauggccacuauugauucauuucagagcuucaauacaaguaccaugcauuuuacugacgaaaggaucgaguggaaggauccagacggcaugcuccgugaucacauaaacauucugguaaccaaagacaucgacuucgauaacuuaggggaaaauccuugcaagaucggacugcagacaucuuccauugagggcgcaugggguagcggggugggauuuacgcuuaccuguuuggucucgcucacugagugccccacauuccugaccucaaucaaagccugcgacaaggcuauuuguuacggcgccgaaucugugacacuaacucggggucagaacaccguuaaagugaguggcaaagggggacacuccggcagcacguuuaagugcugucauggggaggauugcucuccaaauggacugcacgcagcugccccgcaucucgacaaggucaacggcauaagcgaaaucgaaaauuccaagguguaugaugacggugcgccucagugugggauuaaaugcugguucguuaagucaggagaauggaucaguggcauuuuuagcgguaacuggaucgugcugauaguccuuuguguauucuugcuguucucuuuagugcuccuguccauccuuugccccguucgaaaacacaagaagucauga

SEQ ID NO: 10131 - RNA, 3405 nt, Artificial Sequence
  derived and/or modified CDS sequence (opt3) from HTNV__D00376.1__GP
augggcaucuggaaguggcuggugauggccagccucgucuggcccguucuuacccugagaaacguguacgacaugaaaauugagugcccucacacaguauccuucggggaaaauucugugauaggauaugucgaguugccaccgaugcccuuagcugauacugcacagcuggugccugaaucaaguuguagcauggacaaccaucaaucccuaaauacgaucaccaaguacacacagguuucuuggagggguaaagccgaucagucgcagucaagccaaaacaguuuugagacuguguccaccgaagucgaccucaagggcacaugcgugcugaaacacaagaugguagaggagucuuaucggagccgcaaguccauuaccuguuacgaucuuucaugcaauaguacuuauuguaaaccaacacuguacaugaucguucccauucaugcgugcaacaugaugaaaagcuguuugaucgcucucgggccuuaucgagugcaggucguguacgaacguaccuacugcaugacgggagugcugauagagggcaaguguuucgucccagaccagucuguuguguccaucauuaagcacgguaucuuugauauugccucaguacauaucgugugcuucuuugucgcagugaaagggaauacuuauaagauauucgaacagguuaagaaaaguuuugagaguaccuguaacgacacagagaauaaggugcaaggauacuauauuugcaucgucggcggcaacucugcccccauuuacgugccuacucuggaugacuucagauccauggaagcauuuaccgggaucuucaggagcccacacggagaggaucacgaccucgcuggugaagagacagccaccuauucgaucguaggcccggcuaaugccaaaguuccccauucugcguccucagauacguuaagucugauugcauuuagcgggauaccuuccuacucuagccuuucaaucuugacuagcuccacagaagccaagcacguguucagcccaggacuguuucccaaacuaaaccauaccaauugcgacaagggcgcuauuccucucauguggacugguaugaucgacgucccacgguauuacgaugggauacaccccuucacaguguucuguguccugucuggaccgggcgccucaugcgaggcauuuagugagggcgggauuuucaacaucaccagcccuaugugucuuguguccaaacagaaucgcuuuagacugacggaacagcagguuaacuucgugugccaaaggguagacgucgauaucgugguuuacuguaacggacagcggaaggugauuuugaccaagacacucgucaucggucagugcauuuauacuauaaccucucuguuuucguuacugcccggcguggcucacagcaucgccguagagcucugugugccaggguuccauggaugggcgacagccgcacuucugguuacuuuuugcuucggcugggucuugauuccugcugugaccuuuaucauccuagccauucugaaauucauagcuaauaucuuucacacauccaaccaagaaaaucgccucaagucagugcugcgaaaaauuaaggaggaguucgagaaaaccaaggguaguauggucugugacguuugcaaguacgagugugaaacuuauaaagagcuuaaggcccauggggugucuugcccccagagccagugcccauacuguuuuacgcacugcgaacccacagaggcagccuuccaggcucauuauaaagugugucaaguaacccacagauucagggaugaccugaagaaaacugucaccccucagaacuuuacaccaggcugcuaccggaccuugaaucucuuccguuauaagucccgcuguuacaucuuuacuauguggauuuuccuguuagugcuggaaucaauccuaugggcggcaagcgccucugagacaccgcucacgcccguuuggaacgauaaugcucacggagugggcuccauaccuaugcauaccgaccuggagcuugauuuuaguuugacuagcaguuccaaguacacauauagaaggaaacugaccaacccacucgaagcccagucaaucgaccugcacauugagaucgaggaacagacaauuggggucgaugugcaugcacuuggacacugguucgacggucggcugaauuugaagacuucuuuucacugcuacggcgccuguaccaaauaugaguaccccuggcauacggcuaagugccacuaugaacgagacuaccaauaugagaccagcuggggguguaacccuucggauugcccaggauguggcacagguugcacugccugcgggcucuaccuggaccgcuuaaaacccguuggcuccgcauacaagaucauaaccauuagauauucuaggcggguguguguacaguucggagaagagaaucugugcaagaucauugauaugaacgacuguuuugucagccgccaugugaaagugugcaucauaggcacagucucaaaguucagucagggggauacucuacucuuuuucggaccgcuggaagguggcgggcuuaucuuuaaacacuggagaaccuccacgugucaguucggagacccuggcgauauuaugucuccaagggacaaggguuucuugugccccgaguuuccugggagcuuccguaaaaaguguaauuuugcgacaacccccaucugcgaguacgauggcaacaugguuuccggauauaaaaaggugauggcuacuauugacucauuccagagcuuuaauacaaguaccaugcauuucacugaugaacggaucgaguggaaggacccagauggcaugcugcgagaccacauaaacauucucguaaccaaagacaucgauuuugacaaccugggggaaaauccuuguaagaucggauuacaaacaucuuccauugagggcgccugggguagcggggugggauucacgcugaccugccuugucucguugacugaaugucccacauuucucaccucaaucaaagcaugcgauaaggccauuugcuacggcgcugagucugugacacugacuagaggucagaacaccguuaaagugaguggcaaagggggacacuccggcagcacguucaaguguugccauggggaggacuguucuccaaauggacuacacgccgcagcuccgcaucuggauaaggucaacggcauaagcgaaaucgaaaauuccaaggaauaugacgauggugccccucagugcgggauuaaauguugguuugugaagucaggagaguggaucaguggcauuuucagcgguaacuggaucguucucauagugcugugcgucuuccuuuuguuuucucugguauuacucuccauccugugucccgugaggaaacacaagaagucauga

SEQ ID NO: 10132 - RNA, 3417 nt, Artificial Sequence
  derived and/or modified CDS sequence (opt3) from LANV(510B)__AF005728.1__GP
auggagggcuggcuguucaccauccucggggugugcuacauuaugacaacuguccuucccaagacgauauaugaacugaaaauggaguguccucacaccguuggauugggucagggcuacaucauugggagcgccgaauuaggacugaucgacauugcuacagugccagagaucaagcuagaauccucuugcaacuuugaucuccauacuaccucaaguacacaaaaaucuuucacccagcuggaguggagaaagaaagcagagacuacagacaccacgcaggccgcguccacuaccuuugaagcucagacaaagacuguaaauauaaggggcaccuguauccuugccucugaucuguaugacacauugaagcgggugaaaaagaccguccucugcuacgaucugacguguaaccaaacucagugccagccgacaguguaucugauuacccccguugguacuuguaugucgauccgcucaugcauggcaaaucucuuaagcaaccguauucagaucacauucgagaaaacccacugugugacggggcaacuggucgaaggacagugcuuuaauccuagucauucccuuaccuugucucagccaccccacacauacgacgugguaacucugccuaccacauguuucuuuacugccaagaaagcugaucaguauaagauaguuaagaccuucgagggcauuaucagcaaaacaggcugcaccgagaacuccauucaaggguacuacgugugcuuuaucggaucacauagugaaccacuaaucauucccacucucgaggacauacgaagcgcagaacuggccucuagaaugcuucugcacccuaggggugaggaucacgacccauugcagaaugcucaggccguccuccggaucgugggcccgauuacggcgaaggugcccuccucaagcaguacagaaacccugcaagggaucgcauucgccggagucccuauguauucuuccuuuagcacuuuaguucgcaacgcugauccagaguacguguucucgcccggcauaauuccugagucuaaucaguccguaugugacaaaaagacccugccacucacauggaccgguuaucuucccaucucaggggaaauggagaaagugacuggaugcacagucuuuuguacgcuggccggcccgggcgcaaacugcgaggcuuacagugaaagcgggaucuucaauauuuccucuccuaccuguuuggugaacaagguucagagauucaggggaagcgaacagaaaaucaauuuuaugugccaacggauugauaacaauguggucguguauuguaacggucagaagaagguaauacuaacuaaaacacugguuaucggccagugcauuuacaccuucacaucacucuuuagucugaugcccgacguggcccauucccuugcggucgagcugugugugccaggguugcacggaugggccacuaucgcacuccugagcaccuucugcuuuggcugguuacugaucccugguauuacgcuaauaguccucaagauccugaaaauucuuaccuauucuuguucacauuacaguagcgaguccaaguucaaaaugaucuuggaaaaggugaagguugaguaccagaaaacaauggggucuauggugugcgacauuugccaccacgaaugugagacuguaaaggaacuggagucgcauaaacaaagcugcgucgagggccagugucccuauugcaugaccgugacagaagcuacucaguccgcccuccaggcucacuuuucaaucuguaagcugaccggacgcuuccaugaggcccuuaaaaagagucugaagaaaccagaaguucaccgaggcugcuacagaacguuggggguguuuagguaucggucucguuguuacgucggacucgugugggguugccuguuaacaauagagcugguacuaugggcagccagcgcugagacuccccuccuggaaccuggcugguccgauaccgcgcauggggugggagagcuuccauugaagacagaccuggaacucgauuucucacugccgagcagcuccaguuauagcuaccgcagaagguuaaccaaccccgcaaauaaagaggaaucucugccuuuucacuuccaaauggagaagcagguuauccacgccgagauucagucccuuggccauuggauggacgcuacuuuuaacaucaaaaccgccuuccacuguuauggugcaugcaagcaguacucauacccauggcaaacagccaaguguuucuuugaaaaagauuaucaguacgagacgggguggggcugcaaucccggagacugcccuggcgucgggaccggauguacugcuugcgguauuuauuuggauaagcucaaaagugugggcaaggccuacaaagugaucagccugaaguauacacggaaagucuguauacagcuagggaccgaacaaguuugcaagcauauugacgcaaacgauugucuggugacaccaucggugaagguaugcaucauuggaacugucuccaaaauccagcccucugacacccuccuguuccuuggcccguuggagcaggguggggugauacugaagcagugguguacgacaagcugcaccuuuggcgauccuggagacaucaugucaacuaccaguggcaugcgauguccagaacacacaggguccuuccgcaaaauuugcggauuugcgacuacccccguuugugaguaccaaggcaauacaaucucugguuaucagagauuaauggcuacgaaggacagcuuccaguccuuuaaccucaccgauccucacauuacuucaagcaaacuggaguggaucgaccccgaugggaauacaagggaccaugugaaccuuauacugaaucgggaugucaguuuccaggacuugucugauaacccaugcaagguggaccuccacacccaauccauugauggagccuggggcagcgguguuggcuuuacucugacaugcgugguagggcuaaccgaauguccuucguucaucacgucaaucaaggcaugcgaccuggccauguguuacggaucuacugucgcuacccucgcccgcggcaguaauacagugaaaguggucgggaagggaggccauuccgguagcucuuuuaaaugcugucacgauagcgacugcuccucagaggggcugauggcaagugcuccccaucuugaaagaguuaccggauucaaccagauugauagcgacaagguguacgacgauggcgccccaccguguucuuuuaaaugcugguucacuaaguccggugagugguugcugggcaucuuaaaugggaacuggauuguaauagcggugcucgucaucauucugaucauuucaaucauacuuuucaguuuucuguguccuaggcguagccacaagaaaaauguguga

SEQ ID NO: 10133 - RNA, 3402 nt, Artificial Sequence
  derived and/or modified CDS sequence (opt3) from LQUV(Longquan-Rs-32)__JX465402.1__GP
augaagaguauccugcucauucuucuguuggagcagguaagauccaaagccaccaacgaaauaaaguuagagugcccccacgaccaaagggucgaaacaggcuucucucauggguuuacugaucugucaccuauccuauacacgaaaggacucuucaccaagcaccuggagaauaacuguccauuugacauuaguaucauuaaucggcuuguucgcgaugugcgaaucagcacauggcaggcuaaauccacuaacaccgacgcaacaguagccucugcgaccucguucgaaacuaaggauacagacgauaagcuggcuggugugugcggcuuuuucgacgauauaaccaaaccgaagcaggggcagcguaaagccaucauuuguuaugacuugucaugcaaucaaacgcauugucuccccacucugcaccugaucuuuccucagcaguucugccagagccucaagcaauguaguauuaacgcauacgaucauaaaaucuuaauaaccauuucccugucuuuuugcccagagggacuuaucauuggcgguaauuguaucguccccguguuggcccagagccagcugcuacacaaccacaugacauauaauaucaagguuacuugcuucuuugaguacuccauggcuagagaaucacucgacaacaaguuccuggaggaaaugaauaggcuugugcuggggcggaacugugagaaaaccgaguauuugggaggcuacgucugcuuucucgcaggcuaugggacagccauucaugugccuuacgauaauaccuaccugaguggagcuguaguuaacagcaugaaggccaauuuacacggugaagaccaugaccgccugaaacucggcgauacgucugcggugauagcagggaaccuuaaguucgucaucgacuccacugccccagagaaaucauaucagggagaaugcuucacaggccacauggguuacaccagccuguauuuuuaccccgugagaaguaaggggaaauaugugacuauuuugacaaagggagucaucccuguuauaaacaagaccacguguaugccaaaaauugugccgcuaguauggaccggcaugguggagaugaggggcaucgaagagaagcuggaggcuugcacaaugcacuguaucauggucgggaauggagccacuugcgaagcauucucugcuaccgguauuuuugauaucaaauccacaacuugucaaauuggcaagacccauaaauaccggcgcacagaggaccagauaaccuucacuugccaggaucucaacaaggacaucagcgugauuuguaauggggaaaacaucacgguucccgugaagucgcugaucgucggacaaugcauuuauacaauaaccucuaucuuuuccauuuucccugccacugcgcacucaaucgccaccgagaugugugugcagggcauucaugguuggcuuacaaucauaaucuuuuucaccuuuugcuucggguggcuguugauuccaauccucacuugucugauuaucaauacaauagcauacaguuuaauuacgcuggcuuacuuuaaaaacggcgcccgacuaggaaaucucaucaagagaaugaaaagcgaguuccagaggaccauuggcaacacuacaugcaauaucugccugcgggagugugaguccgaaucugaguauaagagccacgaagaacuuugcaaaaacgggucaugucccuacugcaugaaggauauaggaguaagucagguuuugcugaaugaacauuauaacgcuuguaugcucaucgaccguuacgagaagcgccugacccacacacuuaaucaaacuccucuguauuccagaaaagugaggaagauucagagcuuucgguaccgaaaccgcugcuucaucuugaccgucuggauuauccuccugacgguggagucuuuaauaugggccucaagugcagaagauauuaaaccagcccccaaguggcagaauaccgcucacgguaucggcacaaucaaacugaacagcgacuaugagcuagauuucuccgucguggcggggucugaauuuacucauaagagaaugcuccagucgccggagagcggaaagaaaaacauuccuuucaccguuuaccuguccgagcaacuuaucacaucaacugugcagauuuugggcaauuggauggacgcagaaauaaacguaaagagugucuuucacuguuacgguaccugcaaaaaguauucuuaccccuggcagagcuccccaugucauaaagagguggacuucgaauuucagucaagcugggggugcaauccuaucucuugucccggcauuaacuccggaugcacggccugcggcacauauguugauaagcugaaaaccaucgcuaaggccuacaggauuaucacugugaaguauagucggaaagucuguuaccaaauagggacaaagaaagcaugcaagacccucgagagcaaugacugucuggugucuaacggaguaaaaaucugcgccauugguacuaucuccaccuuacagacaggcaugacgcugguguucuuugggccacuuaauggaggcgcuuugcucauuaaggauugguguaucucaaguugcaaguucggugaccccggggauauaaugcagauuagcaacaauaucaccuguccuucguuugacggcacuaugcagcgcguuugcagauucggacuggaaccaauguguuccuauucuggcaacaaaaucagcggggucaagagggugcuagagacaaaagauucauaccugagugugaaucucaccaagccgaaacuggucggauccacacuuuuguggaacucucuggacagcuccauuaaggaucacauaaauaucguugugucaaacgacauugauuuugaggacuuagccgaaacucccugcaaggugaccaucaaaaaucucaagauugagggcgcaugggguagcgggaucggaauaaaacugcacugugaaguaagucuuucugagugcuccgaauaccugacgacaaucaaggucugcgauaacgcgauuuguuauggcgguaacguggcucauuugagccguggccucaauaccguuaucauuaaaggggccggaggccacucggggucaucuuucaagugcugucaugagacuagcugcuccgacaucggauuuaaggcagaggccccucaccuggcucggauaguggacgauggcauuaccacaagcaugucuuacagcgacggugccccagaagcagggaucgucuccuggaucuauaaaguggcugaguggauuaagggaauguucaacggcaauugguucguucuaaucauaaugauucuguuucucaucauuucaaucgugcugcuuauauucuugugucccgugaaaaaguacaaauga

SEQ ID NO: 10134 - RNA, 3402 nt, Artificial Sequence
  derived and/or modified CDS sequence (opt3) from LQUV(Longquan-Ra-25)__JX465397.1__GP
augaaaagcauccugcucauucuucuguugggccaggugagauccaaagccaccaacgagauaaaguuagaaugcccccacgaccaaagggucgagacaggguucucucauggauuuacugaucugucaccuauccuauacacgaaaggucucuucaccaagcaccuggaaaauaacuguccauuugacauuaguaucauuaaucggcuuguucgcgaugugcgaaucagcacauggcaggcuaaauccacuaacaccgacgcaacaguagccucugcgaccucguucgagacuaaggauacagacgauaagcuggcuggcgugugcggguuuuucgacgauauaaccaaaccgaagcagggacagcguaaagccaucauuuguuaugacuugucaugcaaucaaacgcauugucuccccacucugcaccugaucuuuccucagcaguucugccagagccucaagcaauguaguauuaacgcauacgaucauaaaaucuuaauaaccauuucccugucuuuuugcccagaaggccuuaucauuggugggaauuguaucguccccguguuggcccagagccagcugcuacacaaccacaugacauauaauaucaagguuacuugcuucuuugaguacuccauggcuagagagucacucgacaacaaguuccuggaagagaugaauaggcuugugcugggacggaacugugaaaagaccgaguauuugggcggcuacgucugcuuucucgcaggguauggaacagccauucaugugccuuacgauaauaccuaccugaguggugcuguaguuaacagcaugaaggccaauuuacacggcgaggaccaugaccgccugaaacucggggauacgucugcggugauagcaggaaaccuuaaguucgucaucgacuccacugccccagaaaaaucauaucagggcgagugcuucacaggucacaugggguacaccagccuguauuuuuaccccgugagaaguaagggaaaauaugugacuauuuugacaaagggcgucaucccuguuauaaacaagaccacguguaugccaaaaauugugccgcuaguauggaccggcaugguggaaaugagggggaucgaggaaaagcuggaggcuugcacaaugcacuguaucauggucggaaauggugccacuugcgaggcauucucugcuaccggcauuuuugauaucaaauccacaacuugucaaauugggaagacccauaaauaccggcgcacagaagaccagauaaccuucacuugccaggaucucaacaaggacaucagcgugauuuguaauggagagaacaucacgguucccgugaagucgcugaucgucggccaaugcauuuauacaauaaccucuaucuuuuccauuuucccugccacugcgcacucaaucgccaccgaaaugugugugcaggguauucauggguggcuuacaaucauaaucuuuuucaccuuuugcuucggcuggcuguugauuccaauccucacuugucugauuaucaauacaauagcauacaguuuaauuacgcuggcuuacuuuaaaaacggagcccgacuaggcaaucucaucaagagaaugaaaagcgaguuccagaggaccauugggaacacuacaugcaauaucugccugcgggaaugugaguccgagucugaauauaagagccacgaggaacuuugcaaaaacggaucaugucccuacugcaugaaggauauagguguaagucagguuuugcugaaugagcauuauaacgcuuguaugcucaucgaccguuacgaaaagcgccugacccacacacuuaaucaaacuccucuguauuccagaaaagugaggaagauucagagcuuucgguaccgaaaccgcugcuucaucuugaccgucuggauuauccuccugacgguggagucuuuaauaugggccucaagugcagaggauauuaaaccagcccccaaguggcagaauaccgcucacggcaucgggacaaucaaacugaacagcgacuaugaacuagauuucuccgucguggcgggaucugaguuuacucauaagagaaugcuccagucgccggaaagcggcaagaaaaacauuccuuucaccguuuaccuguccgagcaacuuaucacaucaacugugcagauuuuggguaauuggauggacgcagagauaaacguaaagagugucuuucacuguuacgggaccugcaaaaaguauucuuaccccuggcagagcuccccaugucauaaagaaguggacuucgaguuucagucaagcuggggcugcaauccuaucucuugucccggaauuaacuccggcugcacggccugcgggacauauguugauaagcugaaaaccaucgcuaaggccuacaggauuaucacugugaaguauagucggaaagucuguuaccaaauaggaacaaagaaagcaugcaagacccucgaaagcaaugacugucuggugucuaacgguguaaaaaucugcgccauuggcacuaucuccaccuuacagacagggaugacgcugguguucuuuggaccacuuaauggcggugcuuugcucauuaaggauugguguaucucaaguugcaaguucggggaccccggcgauauaaugcagauuagcaacaauaucaccuguccuucguuugacggaacuaugcagcgcguuugcagauucggccuggagccaauguguuccuauucugggaacaaaaucagcggagucaagagggugcuagaaacaaaagauucauaccugagugugaaucucaccaagccgaaacuggucggcuccacacuuuuguggaacucucuggacagcuccauuaaggaucacauaaauaucguugugucaaacgacauugauuuugaggacuuagccgagacucccugcaaggugaccaucaaaaaucucaagauugaaggugcaugggggagcggaaucggcauaaaacugcacugugagguaagucuuucugaaugcuccgaguaccugacgacaaucaaggucugcgauaacgcgauuuguuaugguggcaacguggcucauuugagccgugggcucaauaccguuaucauuaaaggagccggcgggcacucgggaucaucuuucaagugcugucaugaaaccaguugcuccgacaucggcuuuaaggcagaggccccucaccuggcucggauaguggacgaugguauuacuacaagcaugucuuacagcgacggggccccagaggcaggaaucaucuccuggauuuauaaagucgcugaauggaucaagggcauguucaacgguaauugguucgugcuaauaauuaugauccuguuucucauuaucucaauaguucugcuuauuuucuugugucccgugaaaaaguacaaauga

SEQ ID NO: 10135 - RNA, 3402 nt, Artificial Sequence
  derived and/or modified CDS sequence (opt3) from LQUV(Longquan-Ra-5)__JX465398.1__GP
augaaaagcauccugcucauucuucuguugggccaggugagauccaaagccaccaacgagauaaaguuagaaugcccccacgaccaaagggucgagacaggguucucucauggauuuacugaucugucaccuauccuauacacgaaaggucucuucaccaagcaccuggaaaauaacuguccauuugacauuaguaucauuaaucggcuuguucgcgaugugcgaaucagcacauggcaggcuaaauccacuaacaccgacgcaacaguagccucugcgaccucguucgagacuaaggauacagacgauaagcuggcuggcgugugcggguuuuucgacgauauaaccaaaccgaagcagggacagcguaaagccaucauuuguuaugacuugucaugcaaucaaacgcauugucuccccacucugcaccugaucuuuccucagcaguucugccagagccucaagcaauguaguauuaacgcauacgaucauaaaaucuuaauaaccauuucccugucuuuuugcccagaaggccuuaucauuggugggaauuguaucguccccguguuggcccagagccagcugcuacacaaccacaugacauauaauaucaagguuacuugcuucuuugaguacuccauggcuagagagucacucgacaacaaguuccuggaagagaugaauaggcuugugcugggacggaacugugaaaagaccgaguauuugggcggcuacgucugcuuucucgcaggguauggaacagccauucaugugccuuacgauaauaccuaccugaguggugcuguaguuaacagcaugaaggccaauuuacacggcgaggaccaugaccgccugaaacucggggauacgucugcggugauagcaggaaaccuuaaguucgucaucgacuccacugccccagaaaaaucauaucagggcgagugcuucacaggucacaugggguacaccagccuguauuuuuaccccgugagaaguaagggaaaauaugugacuauuuugacaaagggcgucaucccuguuauaaacaagaccacguguaugccaaaaauugugccgcuaguauggaccggcaugguggaaaugagggggaucgaggaaaagcuggaggcuugcacaaugcacuguaucauggucggaaauggugccacuugcgaggcauucucugcuaccggcauuuuugauaucaaauccacaacuugucaaauugggaagacccauaaauaccggcgcacagaagaccagauaaccuucacuugccaggaucucaacaaggacaucggagugauuuguaauggcgagaacaucacgguucccguaaagagccugaucgucggucaaugcauuuauacaauaaccucgaucuuuucuauuuucccugccacugcgcacuccaucgccaccgaaaugugugugcaggggauucauggcuggcuuacaaucauaaucuuuuucaccuuuugcuucggauggcuguugauuccaauccucacuugucugauuaucaauacaauagcauacucauuaauuacgcuggcuuacuuuaaaaacggcgcccgacuagggaaucucaucaagagaaugaaaagugaguuccagaggaccauuggaaacacuacaugcaauaucugccugcgggaaugugagagcgaguccgaauauaagucucacgaggaacuuugcaaaaacgguagcugucccuacugcaugaaggauauaggcguaucacagguuuugcugaaugagcauuauaacgcuuguaugcucaucgaccguuacgaaaagcgccugacccacacacuuaaucaaacuccucuguauaguagaaaagugaggaagauucaguccuuucgguaccgaaaccgcugcuucaucuugaccgucuggauuacgcuccugaccguggagagcuuaaucugggccucuucagcagaggauauaaaaccagcccccaaguggcagaauacagcucacgggauuggaacuaucaaacugaacagugacuaugaacuagauuucagcgucguggcgggcuccgaguuuacccauaagagaaugcuccagucuccggaaucggguaagaaaaacaucccuuucacaguuuaccugagcgagcaacuuauuacuuccaccgugcagaucuuggggaauuggauggacgcagagauuaacguaaagucagucuuucacuguuacggcacgugcaaaaaguauaguuaccccuggcagucuagcccaugucauaaagaaguggacuucgaguuucaguccucauggggaugcaauccuauaagcugucccggcaucaacucugggugcacagccugcggaaccuauguugauaagcugaaaacuauugcuaaggccuacaggaucauuacagugaaguauucccggaaagucuguuaccaaaucgguaccaagaaagcaugcaagacucucgaaaguaaugacugucuggugagcaacggcguaaaaauaugcgccaucgggaccauuucuacauuacagacgggaaugacccugguguucuuuggcccacuuaaugguggggcuuugcucaucaaggauugguguauuuccucaugcaaguucggcgaccccggagauaucaugcagauaaguaacaauauuacuuguccuagcuuugacggcacaaugcagcgcguuugcagauucgggcuggagccaauguguucguauuccggaaacaaaaucucuggcgucaagagggugcuagaaaccaaagauagcuaccugucagugaaucucacaaagccgaaacuggucgguaguacucuuuuguggaacucccuggacucuagcaucaaggaucacauuaauauaguuguguccaacgacaucgauuuugaggacuuagccgagacccccugcaaggugacgauuaaaaaucucaagaucgaaggggcauggggaucaggcauugguaucaaacugcacugugagguaagccuuagugaaugcucugaguaccugacaaccauaaaggucugcgauaacgcgaucuguuauggcgggaacguggcucauuugucccguggacucaauacuguuauuaucaaaggcgccgggggacacagcggcucgucauucaagugcugucaugaaaccucuugcagugacauugguuuuaaggcagaggccccucaccuggcucggaucguggacgaugggauaacaacuuccaugagcuacucugacggagccccagaggcaggcauugucagcuggaucuauaaaguggcugaauggaucaaggguauguucaacggcaauugguucguucuaauuaucaugauacuguuucucauuaucuccauugugcugcuuaucuucuugugucccgugaaaaaguacaaauga

SEQ ID NO: 10136 - RNA, 3402 nt, Artificial Sequence
  derived and/or modified CDS sequence (opt3) from LQUV(Longquan-Ra-56)__JX465399.1__GP
augaaaagcauccugcucauucuucuguugggccaggugagauccaaagccaccaacgagauaaaguuagaaugcccccacgaccaaagggucgagacaggguucucucauggauuuacugaucugucaccuauccuauacacgaaaggucucuucaccaagcaccuggaaaauaacuguccauuugacauuaguaucauuaaucggcuuguucgcgaugugcgaaucagcacauggcaggcuaaauccacuaacaccgacgcaacaguagccucugcgaccucguucgagacuaaggauacagacgauaagcuggcuggcgugugcggguuuuucgacgauauaaccaaaccgaagcagggacagcguaaagccaucauuuguuaugacuugucaugcaaucaaacgcauugucuccccacucugcaccugaucuuuccucagcaguucugccagagccucaagcaauguaguauuaacgcauacgaucauaaaaucuuaauaaccauuucccugucuuuuugcccagaaggccuuaucauuggugggaauuguaucguccccguguuggcccagagccagcugcuacacaaccacaugacauauaauaucaagguuacuugcuucuuugaguacuccauggcuagagagucacucgacaacaaguuccuggaagagaugaauaggcuugugcugggacggaacugugaaaagaccgaguauuugggcggcuacgucugcuuucucgcaggguauggaacagccauucaugugccuuacgauaauaccuaccugaguggugcuguaguuaacagcaugaaggccaauuuacacggcgaggaccaugaccgccugaaacucggggauacgucugcggugauagcaggaaaccuuaaguucgucaucgacuccacugccccagaaaaaucauaucagggcgagugcuucacaggucacaugggguacaccagccuguauuuuuaccccgugagaaguaagggaaaauaugugacuauuuugacaaagggcgucaucccuguuauaaacaagaccacguguaugccaaaaauugugccgcuaguauggaccggcaugguggaaaugagggggaucgaggaaaagcuggaggcuugcacaaugcacuguaucauggucggaaauggugccacuugcgaggcauucucugcuaccggcauuuuugauaucaaauccacaacuugucaaauugggaagacccauaaauaccggcgcacagaagaccagauaaccuucacuugccaggaucucaacaaggacaucagcgugauuuguaauggagagaacaucacgguucccgugaagucgcugaucgucggccaaugcauuuauacaauaucuuccaucuuuucaauuuucccugccaccgcgcacaguaucgccacugaaaugugugugcagagcauucaugguuggcuuaccaucauaaucuuuuucacauuuugcuucggguggcuguugauuccaauccucaccugucugauuaucaauacuauagcauacuccuuaauuacacuggcuuacuuuaaaaacggcgcccgacuaggaaaucucaucaagagaaugaaaucugaguuccagaggacgauuggcaacaccacuugcaauaucugccugcgggaaugugagagcgagucagaauauaagagucacgaggaacuuugcaaaaacggguccugucccuacugcaugaaggauauaggaguaagccagguuuugcugaaugagcauuauaacgcuuguaugcucaucgaccguuacgaaaagcgccugacacacacccuuaaucaaacaccucuguauucuagaaaagugaggaagauucagucauuucgguaccgaaaccgcugcuucaucuugacugucuggauuauccuccugaccguggagaguuuaauaugggccagcuccgcagaggauauuaaaccagcccccaaguggcagaauacggcucacgguaucggcaccaucaaacugaacucugacuaugaacuagauuucucggucguggcggggagcgaguuuacacauaagagaaugcuccaguccccggaaucaggaaagaaaaacauuccuuucacuguuuaccugagugagcaacuuaucaccucuacagugcagauuuugggcaauuggauggacgcagagauaaacguaaagagcgucuuucacuguuacgguacuugcaaaaaguauuccuaccccuggcagucaagcccaugucauaaagaaguggacuucgaguuucagucuuccugggggugcaauccuaucaguugucccggcauuaacagcggaugcaccgccugcggcacguauguugauaagcugaaaacaaucgcuaaggccuacaggauuaucaccgugaaguauucucggaaagucuguuaccaaauagggacuaagaaagcaugcaagacacucgaauccaaugacugucuggugucaaacggaguaaaaaucugcgccauugguaccaucaguacuuuacagaccggcaugacacugguguucuuugggccacuuaauggaggcgcuuugcucauuaaggauugguguaucagcucgugcaaguucggugaccccggggauauaaugcagauuuccaacaauaucacguguccuucuuuugacggcaccaugcagcgcguuugcagauucggacuggagccaauguguagcuauucaggcaacaaaaucaguggggucaagagggugcuagaaacuaaagauuccuaccugucugugaaucucacaaagccgaaacuggucggaagcacccuuuuguggaacucccuggacucaagcauuaaggaucacauaaauaucguugugaguaacgacauugauuuugaggacuuagccgagacacccugcaaggugacuaucaaaaaucucaagauugaaggcgcaugggguucugggaucggaauaaaacugcacugugagguaucccuuagcgaaugcucgaaguaccugaccacgaucaaagucugcgauaacgcgauuuguuauggcgguaacguggcucauuugucacguggccucaauacaguuaucauuaagggggccggaggccacucugggaguuccuucaagugcugucaugagaccagcugcucugacaucggauuuaaagcagaagccccucaccuggcucggauaguggacgauggcauuacuaccagcauguccuacucagacggugccccagaggcagggaucgucaguuggaucuauaagguggcugaguggauuaaaggaauguucaacggcaauugguucguucuaaucauaaugauucuguuucucaucauuagcaucgugcugcuuauauucuugugucccguaaagaaauacaaguga

SEQ ID NO: 10137 - RNA, 3402 nt, Artificial Sequence
  derived and/or modified CDS sequence (opt3) from LQUV(Longquan-Ra-90)__JX465400.1__GP
augaaaagcauccugcucauucuucuguugggccagguaagauccaaagccaccaacgagauaaaguuagaaugcccccacgaccaaagggucgagacaggguucucucauggauuuacugaucugucaccuauccuauacacgaaaggucucuucaccaagcaccuggaaaauaacuguccauuugacauuaguaucauuaaucggcuuguucgcgaugugcgaaucagcacauggcaggcuaaauccacuaacaccgacgcaacaguagccucugcgaccucguucgagacuaaggauacagacgauaagcuggcuggcgugugcggguuuuucgacgauauaaccaaaccgaagcagggacagcguaaagccaucauuuguuaugacuugucaugcaaucaaacgcauugucuccccacucugcaccugaucuuuccucagcaguucugccagagccucaagcaauguaguauuaacgcauacgaucauaaaaucuuaauaaccauuucccugucuuuuugcccagaaggccuuaucauuggugggaauuguaucguccccguguuggcccagagccagcugcuacacaaccacaugacauauaauaucaagguuacuugcuucuuugaguacuccauggcuagagagucacucgacaacaaguuccuggaagagaugaauaggcuugugcugggacggaacugugaaaagaccgaguauuugggcggcuacgucugcuuucucgcaggguauggaacagccauucaugugccuuacgauaauaccuaccugaguggugcuguaguuaacagcaugaaggccaauuuacacggcgaggaccaugaccgccugaaacucggggauacgucugcggugauagcaggaaaccuuaaguucgucaucgacuccacugccccagaaaaaucauaucagggcgagugcuucacaggucacaugggguacaccagccuguauuuuuaccccgugagaaguaagggaaaauaugugacuauuuugacaaagggcgucaucccuguuauaaacaagaccacguguaugccaaaaauugugccgcuaguauggaccggcaugguggaaaugagggggaucgaggaaaagcuggaggcuugcacaaugcacuguaucauggucggaaauggugccacuugcgaggcauucucugcuaccggcauuuuugauaucaaauccacaacuugucaaauugggaagacccauaaauaccggcgcacagaagaccagauaaccuucacuugccaggaucucaacaaggacaucagcgugauuuguaauggagagaacaucacgguucccgugaagucgcugaucgucggccaaugcauuuauacaauaaccucuaucuuuuccauuuucccugccacugcgcacucaaucgccaccgaaaugugugugcaggguauucauggguggcuuacaaucauaaucuuuuucaccuuuugcuucggcuggcuguugauuccaauccucacuugucugauuaucaauacaauagcauacaguuuaauuacgcuggcuuacuuuaaaaacggagcccgacuaggcaaucucaucaagagaaugaaaagcgaguuccagaggaccauugggaacacuacaugcaauaucugccugcgggaaugugaguccgagucugaauauaagagccacgaggaacuuugcaaaaacggaucaugucccuacugcaugaaggauauagguguaagucagguuuugcugaaugagcauuauaacgcuuguaugcucaucgaccguuacgaaaagcgccugacccacacacuuaaucaaacuccucuguauuccagaaaagugaggaagauucagagcuuucgguaccgaaaccgcugcuucaucuugaccgucuggauuauccuccugacgguggagucuuuaauaugggccucaagugcagaggauauuaaaccagcccccaaguggcagaauaccgcucacggcaucgggacaaucaaacugaacagcgacuaugaacuagauuucuccgucguggcgggaucugaguuuacucauaagagaaugcuccagucgccggaaagcggcaagaaaaacauuccuuucaccguuuaccuguccgagcaacuuaucacaucaacugugcagauuuuggguaauuggauggacgcagagauaaacguaaagagugucuuucacuguuacgggaccugcaaaaaguauucuuaccccuggcagagcuccccaugucauaaagaaguggacuucgaguuucagucaagcuggggcugcaauccuaucucuugucccggaauuaacuccggcugcacggccugcgggacauauguugauaagcugaaaaccaucgcuaaggccuacaggauuaucacugugaaguauagucggaaagucuguuaccaaauaggaacaaagaaagcaugcaagacccucgaaagcaaugacugucuggugucuaacgguguaaaaaucugcgccauuggcacuaucuccaccuuacagacagggaugacgcugguguucuuuggaccacuuaauggcggugcuuugcucauuaaggauugguguaucucaaguugcaaguucggggaccccggcgauauaaugcagauuagcaacaauaucaccuguccuucguuugacggaacuaugcagcgcguuugcagauucggccuggagccaauguguuccuauucugggaacaaaaucagcggagucaagagggugcuagaaacaaaagauucauaccugagugugaaucucaccaagccgaaacuggucggcuccacacuuuuguggaacucucuggacagcuccauuaaggaucacauaaauaucguugugucaaacgacauugauuuugaggacuuagccgagacucccugcaaggugaccaucaaaaaucucaagauugaaggugcaugggggagcggaaucggcauaaaacugcacugugagguaagucuuucugaaugcuccgaguaccugacgacaaucaaggucugcgauaacgcgauuuguuaugguggcaacguggcucauuugagccgugggcucaauaccguuaucauuaaaggagccggcgggcacucgggaucaucuuucaagugcugucaugaaaccaguugcuccgacaucggcuuuaaggcagaggccccucaccuggcucggauaguggacgaugguauuacuacaagcaugucuuacagcgacggggccccagaggcaggaaucgucuccuggaucuauaaaguggcugaauggauuaagggcauguucaacgguaauugguucguucuaaucauaaugauucuguuucucaucauuucaaucgugcugcuuauauucuugugucccgugaaaaaguacaaauga

SEQ ID NO: 10138 - RNA, 3423 nt, Artificial Sequence
  derived and/or modified CDS sequence (opt3) from NYV(Rhode Island-1 (RI-1))__U36801.1__GP
auggugggcugggucugcaucuuccugguugugcucgccaccacaacugcugggcuuacgagaaaccuguacgaguugaagauugaauguccccacaccguaggauuaggucagggcuaugugacagggagcgucgagacuaccccuauacugcuaacacaagugaccgaccucaaaaucgaauccucuugcaauuuugaucugcauguuccaucaacaaguauucagaaguacaaccagguggagugggccaaaaagagcuccacuaccgaaucuacgucggcaggagcgacuaccuucgaggcuaaaacaaaggaggucucacuuaagggcacuuguaauaucccggugaccacauuugaagccgcauauaaaagcaggaagaccguaauuugcuacgaccuggccuguaaccagacguauugcuugcccacuguucaccucaucgcuccugugcaaacauguaugaguguccgguccugcaugauaggucugcugucuagccgcauccaggugauuuacgagaaaaccuauugugugacugggcagcucgucgaaggauuaugcuucaucccaacacauaccauugcacugacgcagcccggccacaccuacgauacaaugacucuuccuaucaccuguuucuugguugccaagaaacugggcacacaacuaaagauagcuguggagcucgagaagcugauuacugccuccgggugcaccgaaaauucauuucagggauacuauaucugcuuucuugguaaacauagugagccacugagcguacccaugauggacgauuaccgaucugcggaauuguucacacguauggugcucaacccuagaggcgaggaccacgauccagaccagaaugggcagggacugaugaggauugcaggcccgaucaccgccaagguccccuccacugaaacgacagagaccaugcaagguaucgcuuuugccggggcaccuacuuauuccagcuucaguaccuuagugcggaaagcugauccagacuacguguuuucucccggaauuauagccgaguccaaccacagcguuugugauaagaaagcgaucccucugacauggaccggcuuccucgccgucucgggcgaaauugagaagaucacugggugcacaguguuuuguacgcuuguaggaccaggugcaucuugcaaggcuuauuccgaaaccggcauauucaauauuucaagucccacuugucugguuaacaaagugcagaaguuccgcgggagcgagcagagaaucaauuuuaugugccaaagggucgaccaggaugugaucgucuacuguaacggacagaaaaaggugauuuugacaaaaacccuaaucauuggccagugcauauauacauucacuucccuguuuucucucaucccggguguugcccauagccuggcuguggaacuuuguguaccugggcugcacggcugggccaccgcagccuugcucauuacguucugcuuuggauggcuguuaauccccaccaucacaaugauuauacugaagauccuacggcuccugacuuucucauguagucauuacuccaccgagagcaaauuuaaggcuauucuugagcgcgucaagguggaauaccagaaaacaaugggcucuaugguuugcgacgcgugccaccacgagugugaaacugcaaaggaguuggaaacccauaaaaagucaugcccagaggggcaauguccuuauugcaugacgaugacagagaguaccgaaagcgcccugcucgcucacuucuccaucuguaaacugacuaaucgauuucaggagaaccuuaagaagucucugaaaagacccgaagugaagcagggaagguaccggacauugggugucuuccguuauaaaucgcgcugcuacgugggccucguauggggagugcuguuaaccacugagcugauuguuugggccgcaagcgccgacaccccacuaauggaguccggguggucagauacagcucauggcgucgguaucgugcccaugaagacggaccucgaacuggauuuugcccuugcaaguucuagcuccuauucauacagaaggaaauuggugaauccugcgaacaaggaggaaacccugccauuccacuuucaacucgacaagcaggucguucaugcugagauacagaaccuggggcacuggauggauggcacuuucaauaucaaaacagccuuccacuguuauggagaaugcaagaaauacgcauacccguggcagaccgccaagugcuuuuucgagaaagacuaucaauacgagacaagcuggggcuguaaucccccugauuguccaggggugggaacugguugcaccgcuugcggcguguauuuagacaagcugcggucugggggaaaagccuacaagauuguaucccuuaaguuuacgcgaaaagucuguauccaguugggcacagaacagaccugcaagcauauugaugugaacgacugucucguuacucccagugugaaagucugccugaucgguaccauaagcaagcuacagccuggggauacacuccuguuccugggcccacuugagcaaggaggcauuaucuugaaacagugguguacuaccucuugcguguuuggggaccccggagacauuauguccacaacgaccggcaugaaguguccggaacacacugguucauuccgcaagaucugcggguuugcaacaaccccuacuugugaguaucagggaaacacaauaaguggcuuccaaagaaugauggcuaccagggauagcuuucagucguucaauguuacggaaccacauaucacuuccaaccggcuggaguggauugaccccgauucuagcaucaaagaccacauuaauaugguguuaaaccgcgauguaucauuucaggaccucagugauaauccuugcaaggucgaccugcacacccaguccaucgauggugccuggggcucuggggugggauucacacuuguguguaccgucggccugacugagugcgcgaacuuuauaacaagcauuaaagccugcgacuccgcuauguguuacggggcaaccguuacaaauuugcucagaggaucaaacacugugaagguagugggcaaaggugggcauagcaguucucuguucaagugcugucacgauaccgacugcacggaagagggacuagccgcuucacccccacaucuggauagggucacaggcuauaaucaaaucgacagcgacaagguguacgaugacggugccccucccuguaccaucaaaugcugguucacuaagucgggcgaauggcuccuggggauucuuaacggaaauuggguuguggucgcaguguugaucguuauucugauauuaucaauccuccuguuuucuuucuuuuguccaauucguggccggaaaaacaagaguaacuga

SEQ ID NO: 10139 - RNA, 3423 nt, Artificial Sequence
  derived and/or modified CDS sequence (opt3) from NYV(New York-1 (NY-1))__U36802.1__GP
auggugggcugggucugcaucagccugguugugcucgccaccacaacugcugggcuuacgagaaaccuguacgaguugaagauugaauguccccacaccguaggauuaggucagggcuaugugacaggguccgucgagacuaccccuauacugcuaacacaagugaccgaccucaaaaucgaaucuucaugcaauuucgaucugcauguuccaaguacuagcauucagaaguacaaccagguggagugggcaaagaaguccucuacaaccgaaucgacgucagccggagcgacuaccuuugaggcuaaaacaaaggaggucagccuuaagggcacuuguaauaucccggugaccacauucgaagccgcauauaaaaguaggaagaccguaauuugcuacgaccuggccuguaaccagacgcacugcuugcccacuguucaucucaucgcuccugugcaaacauguauguccguccggucuugcaugauaggucugcugagcucccgcauccaggugauuuaugagaaaaccuacugugugacugggcagcucgucgaaggauuaugcuuuaucccaacacacaccauugcacugacgcagcccggccauaccuaugauacaaugacucuuccuaucaccuguuucuugguugccaagaaacugggcacacaacuaaagauagcuguggagcucgagaagcugauuacugccucagggugcaccgaaaauaguuuucagggauacuacaucugcuuccuugguaaacacagcgagccacuguuuguacccaugauggacgauuaucgaucugcggaauuguucacacguauggugcucaacccuagaggcgaggaccacgauccagaccagaaugggcagggacugaugaggauugcaggcccgaucaccgccaagguccccuccacugaaacgacagagaccaugcaagguaucgcuuuugccggggcaccuauguacucaucuuucaguacuuuagugcggaaagcugauccagacuauguuuuuagccccggaauuauagccgaguccaaccauagcgugugugauaagaaaaccaucccucugacauggaccggcuuccucgcggucucgggcgaaauugagaagaucacugggugcacaguguuuuguacgcuuguaggaccaggugccucuugcgaagcauacuccgagaccggcauauucaauauuucaagucccacuugucugguuaacaaagugcagaaguuccgcgggagcgaacagagaaucaauuuuaugugccaaagggucgaccaggaugugaucgucuauuguaacggacagaagaaagugauuuugacaaagacccuaguuaucggccagugcauuuacacauucacuucccuguuuucucucauaccggguguggcucacagccuggccguagagcuuugugucccugggcugcauggcugggcuaccacggccuugcucaucaccuucugcuuuggauggcuguuaauucccacaaucacuaugaucauucugaaaauacuacggcuccugaccuucucauguagucacuauuccacagagagcaaguuuaaagcaauccuugaacgcgugaagguugaguaccaaaagacuaugggcucuauggugugcgacgucugccaccaugaaugugagaccgccaaagaauuggagacgcacaagaaaucaugcccagaggggcaguguccuuacugcaugacaaugaccgaaaguacugagagcgcucugcaggcgcauuucuccauuuguaagcucacaaaucgauuucaggaaaaccugaaaaagucucuuaagagacccgaggugaaacaaggaugcuauaggacccuggguguauuccgguacaagucgcguuguuaugugggcuugguuuggggaguccuccugacuaccgaguuaaucgugugggcagccagcgcugacacaccacugauggaauccggguggucagauacggcccacggcguggguauuguccccaugaaaaccgaccuagagcucgauuuugcacuggccaguucuagcuccuacucauaucgcagaaaacuuguuaauccugcuaacaaagaagagacuuugccauuccauuuucagcuggacaaacagguggugcacgccgaaauccagaaccucgggcacuggauggauggcacauucaauauaaagaccgcauuccauugcuacggagaguguaagaaguaugcguacccguggcaaacagcuaaaugcuuuuucgagaaggacuaccaguaugaaacuagcuggggcuguaaucccccugauugcccagggguaggaaccgguugcacggccuguggcgucuaccuggacaaauuaaggucuguggggaaggcauauaaaaucguuucccugaaguuuacacggaaggugugcauucagcuuggaaccgagcagacuuguaaacacaucgaugucaacgacugcuuggugacccccaguguuaaggugugucucauuggcacaaucagcaaacugcaaccuggugauacucuacuguuccucgggccacuggaacagggcggaauaauucuuaagcaguggugcaccacaucuuguguauuuggcgaccccggggacaucauguccacgaccacuggaaugaaaugcccggagcauacaggcucauuccgaaagauuugugguuuugccaccacuccuacaugcgaauaccaagggaacaccaucaguggauuccagcgcaugauggcuacgagagauagcuuucagucguucaaugucacugagccacacauaaccuccaacagguuggaguggaucgaccccgauucuagcauuaaggaccacaucaauauggugcugaaccgggaugugucauuucaggacuuaagugauaauccuuguaaagucgaccuccauacacaauccauugauggcgccugggguucuggcguuggguucacccuggugugcacuguaggacuuacagaaugcgcaaacuuuaucaccagcauaaaggcuugugacuccgccaugugcuauggcgcgacagugacuaaucuguugcgcgggucaaacaccgucaaagugguuggaaagggcggucacagcgggagucucuucaaauguugccaugauacggacuguacagaggaaggacuggccgcuucucccccacaccuagauagagugaccggcuacaaucagauugacuccgacaaggucuaugaugacggugcaccucccugcacuaucaaguguugguucaccaaaagcggcgaguggcugcucgggauccugaacggaaauugggugguuguggccguccuuauuguaaucuugauucugucgauauuacucuuuucauucuuuugcccaaucaggggccguaagaacaaaucuaacuga

SEQ ID NO: 10140 - RNA, 3423 nt, Artificial Sequence
  derived and/or modified CDS sequence (opt3) from NYV(New York-2 (NY-2))__U36803.1__GP
auggugggcuucgucugcaucuuucugguugugcucgccaccacaacugcugggcuuacgagaaaccuguacgaguugaagauugaauguccccacaccguaggauuaggucagggcuaugugacagggagcgucggaacuaccccuauacugcuaacacaagugaccgaccucaaaaucgaguccucuugcaauuucgaucugcauguuccaucaacuagcauucagaaguacaaccagguggaaugggccaaaaagagcuccacaaccgagucuacgucggcaggcgcgacuaccuuugaagcuaaaacaaaggaggucucacuuaaggguacuuguaauaucccggugaccacauucgaggccgcauauaaaagcaggaagaccguaauuugcuacgaccuggccuguaaccagacgcacugcuugcccacuguucaucucaucgcuccugugcaaacauguaugaguguccgguccugcaugauagggcugcugucuagccgcauccaggugauuuaugagaaaaccuacugugugacuggacagcucgucgagggcuuaugcuuuaucccaacacacaccauugcacugacgcagcccggccauaccuaugauacaaugacucuuccuaucaccuguuucuugguugccaagaaacuggggacacaacuaaagauagcuguggaacucgagaagcugauuacugccggagguugcaccgaaaauuccuuucagggcuacuacaucugcuuccuugggaaacacucagaaccacuguuuguacccaugauggacgauuaucgaagugcggaguuguucacacguauggugcucaacccuagaggagaagaccacgauccagaccagaauggccagggucugaugaggauugcagggccgaucaccgccaagguccccagcacugagacgacagaagcuaugcaaggaaucgccuuugcaggcgcuccuauguacucuuccuucucaaccuuagugcggaaagccgauccagacuauguuuuuagccccggcauuauagcggagaguaaccauucugugugugauaagaaaacuaucccucugaccuggacaggguuccucgccgucuccggagagauugaaaagaucaccgguugcacuguguucuguacacuuguaggcccaggggcaagcugcgaggcuuacucggaaacgggaauauuuaauauuucuucccccaccugucugguuaacaaagugcagaaguuccgcggcucagagcagagaaucaauuuuaugugccaaagggucgaccaggaugugaucgucuauuguaacggucagaagaaagugauuuugacuaagacacuuguuaucgggcagugcauuuacaccuucacaagucuguuuagccucauaccgggcguggcccacucccuggcuguagaacuuugugucccuggacugcauggcugggccacuaccgcauugcucaucacguucugcuuuggguggcuguuaauucccaccaucacaaugaucauucugaaaauacuacggcuccugacuuucucuuguagccacuauucaaccgagaguaaguuuaaagccauccuugagcgcgugaagguugaauaccaaaagacaaugggauccauggugugcgacgucugccaccaugagugugaaacugcuaaagaguuggaaacccacaagaaaagcugcccagagggucaguguccuuacugcaugacgaugacagagucuaccgaaucagcgcugcaggcacauuucaguauuuguaagcucacuaaucgauuucaggagaaccugaaaaagagccuuaagagacccgaagugaaacaaggcugcuauaggacacuggggguauuccgguacaagucccguuguuaugugggauugguuuggggcguccuccugaccacugaguuaaucgugugggccgcuucugccgacaccccacugauggagucggguuggagcgauacagcacacggggugggcauuguccccaugaaaacggaccuagaacucgauuuugcccuggcuuccucaaguucuuacagcuaucgcagaaagcuaguugacccugccaauaaagaggaaaccuugccauuccauuuccagcuggauaaacagguggugcacgcagagauccagaaccucggacacuggauggacggcacuuuuaacauaaagacagcguuccauugcuacggggaauguaagaaguaugcuuacccguggcaaaccgccaaaugcuuuuucgagaaggauuaccaguaugagacauccuggggauguaaucccccugacugcccagguguaggcacugggugcaccgcauguggagucuaccuggauaaauuaaggucagugggcaaggccuauaaaaucguuagccugaaguuuacgcggaaggugugcauucagcuugguacagaacagaccuguaaacacaucgacgucaacgauugcuuggugacucccucuguuaaggugugucucauugggaccaucuccaaacugcaaccuggcgacacacuacuguuccucggaccacuggagcagggcgggauaauucuuaagcaguggugcacuaccaguuguguauuuggagaccccggcgauaucaugagcacaacgaccgguaugaaaugcccggaacauacugggucuuuccgaaagauuuguggauuugcuacaaccccuacuugcgaguaccaaggcaauacaaucuccgguuuccagcgcaugauggccaccagagacucauuucagaguuucaacgucacggaaccacacauaacuagcaauagguuggaguggaucgaucccgacucguccauuaaggaucacaucaacauggugcugaaucgggacgugucuuuucaggauuuaagcgacaacccuuguaaagucgaucuccauacccaaucaauugacggcgcaugggggaguggaguuggcuucacacuggugugcaccguagggcuuacugagugcgcuaauuucaucacauccauaaaggccugugauucugcgaugugcuauggagccaccgugacaaaccuguugcgcggcagcaauacugucaaagugguugguaaagggggacacuccggcucacucuuuaaguguugccaugacaccgauuguacggaagagggucuggcugcaagucccccacaccuagacagagugacaggcuacaaccagauugacagugauaaggucuaugacgauggggccccucccugcaccaucaaguguugguucacuaaaucuggagaauggcugcucggcauccugaaugggaacugggugguuguggcuguccuuauuguaaucuugauucuguccauauuacucuuuagcuucuuuugcccaaucaggggacguaagaauaaaucgaacuga

SEQ ID NO: 10141 - RNA, 3447 nt, Artificial Sequence
  derived and/or modified CDS sequence (opt3) from PUUV(K27)__L08754.1__GP
augggcgagcugagccccgugugccucuaccuucuguugcagggguuacugcuauguaacaccggagccgcuagaaaucucaacgaacugaagauggagugcccucacacaaucaggcuuggucaaggccuggucguuggguccguggaauugccaucucucccgauucagcagguagagacucugaaacuggaaucaaguuguaauuucgaccuccauacgagcaccgcaggacagcaauccuuuacaaaguggacuugggagauaaaaggcgauuuagccgagaacacccaggcgucuucgacaucauuccagaccaagagcagugaagugaaucugcggggucuuugcuugauccccacucuggucguggagacagcugcccgcaugcgaaaaaccauugcauguuaugaccuauccugcaaccagacgguuugucaaccuacuguguaccucauggggccaauccagaccugcauuacaacuaagucuugucugcuuagccugggagaucagcguauccaggucaauuaugaaaagaccuacugcguguccggccaauugguagagggcauauguuuuaaccccauccacacaauggcccucucacagccuagucauaccuaugacauuaugacgaugaugguuagaugcuuccuggugaucaaaaaggucacuagcggggauucuaugaaaauugagaagaauuuugaaacauuagugcagaaaaacggaugcaccgcuaauaacuuccaagguuacuauaucugucugauaggcuccucaagcgagccacucuacgugcccgcacuugacgauuacaggagugccgaaguccugucucggauggcuuuugccccucacggggaggaccaugauauugaaaagaaugcgguuuccgcaaugcgcaucgccggaaaggugacuggcaaagcuccaagcacagagucgucugacaccguacaggguauugccuucuccgggucaccguuguauacgaguaccggagugcuaacaagcaaggaugaccccgucuacaucugggcaccuggcaucauuauggagggcaaccacuccauaugcgagaaaaagacucugccacucaccuggacaggguuuaucucucugcccggagaaauugagaaaacuacccaguguacaguguucugcacccuugcugguccuggcgccgauugugaagcguauagcgaaacugggaucuuuaauauaucaaguccaacgugcuccauuaacagaguucagagguuccggggaagcgagcaacagaucaaguuugugugucagcgcgucgacauggacaucacaguguacugcaacggcaugaaaaagguaauucugaccaagacuuugguuaucggucaguguauuuauaccuucacaucuauauucucacucauccccgggguggcccacagucuggcagucgaguuaugcgugccgggccugcauggaugggcuaccaugcuacuccugcuuacuuuguguuuuggcuggguccugauuccuacaaucacgaugauccuccugaaaauucuuauagccuucgcuuaccugugcagcaaguauaauaccgauuccaaauuucgaaucuugauugaaaaggugaaaagagaguaccaaaagacuauggggucuaugguuugcgaagugugucaguacgagugcgaaacagccaaggagcucgagucgcacaggaaaagcuguuccaucggaucaugccccuauugucugaacccaagugaagcaaccacaucugccuuacaggcucauuucaagguaugcaaacugacuagccgguuucaggagaaucuacguaagucccucaccgucuacgaaccuaugcaagguuguuaucgcacgcugucacuuuucagauacaggagccgguuuuucgugggcuugguuuggugcgugcugcucguccuggaguuaauugugugggcggcaucugccgagacccagaaccugaaugcuggguggacagacacugcccacggauccggcaucauacccaugaaaaccgaucuugaauuggacuuuagucucccaagcucugcauccuauacauaccgacgccagcugcagaaccccgccaaugagcaagaaaagaucccuuuccaccuacagcugucaaagcagguaauucaugcugagauccaacaccucggucauuggauggaugccacuuuuaaccugaaaaccgcauuccacuguuaugggaguugcgaaaaguacgcguacccauggcagacggcuggcuguuuuauugagaaagacuaugaguacgaaacaggauggggcugcaauccgcccgauugcccuggggugggaaccgguuguacugccugcggcguuuaucuugacaaguugaaaagcgucgggaagguguucaagaucgugucgcugagauacacaaggaaagucuguauacaguuaggaaccgagcagacuugcaagaccguugauuccaacgacugucucauuacaacgucugugaaagugugccugaucggcaccauuagcaaguuccaaccaucagauacucuucuguuuuuggguccccuccagcaagggggccugaucuucaaacagugguguacaaccacaugccaguuuggagacccuggcgacauaaugaguacuccaaccgggaugaagugucccgaacuaaauggauccuuccggaaaaagugcgcauuugccacgacaccgguaugucaguucgauggcaacaccaucucugguuauaagcgcaugauugcuacuaaagacagcuuucaguccuucaaugucaccgagccucauaucucaacaagcgcccuggaauggauugauccagacaguucucucagagaucacaucaacgugauaguuuccagggaccugagcuuucaggaucuuucggagacucccugccaaauugacuuggcaaccgcuucaaucgauggggccuggggaucuggcguggguuucaaucuggucugcacagugaguuuaacggaguguuccgcguuucucaccagcaucaaggccugcgacgcugcaauguguuacggcucuacuacagccaaccugguucgugggcagaacaccauucacaucgugggaaaaggcgggcauagcggauccaaguucaugugcugucacgauacuaaaugcucaaguacaggccuuguagcugccgcaccucaucuggaccgggucaccgguuauaaucaggcggauagcgacaagauuuuugacgauggggcccccgaauguggaaugucuugcugguucaagaaauccggcgaguggauacuaggugugcucaacggcaauuggaugguggucgcuguucuggugguauugcugaucuuaucaauucuccuguucacgcuuuguugcccacgaagaccuaguuacaggaaggaacacaaacccuga

SEQ ID NO: 10142 - RNA, 3447 nt, Artificial Sequence
  derived and/or modified CDS sequence (opt3) from PUUV(13891)__U22418.1__GP
augggcaagaucauucccgugugccuguaccuccuuuuccuguguuuguuacuguggaacagaggggacgccaggaaucuaaacgagcucaaaauggaaugcccucacaccauaggacugggucagggccuugucaucgggagcguugagcugccaccggugcccuugacacaaguagaaucccucaagcuggagucuucauguaauuuugaucugcauacgaguacuagcucccagcagucuuucaccaaauggacaugggaaauuaagaacgaccucgcugagaauacucaggcaucgucaaccagcuuucaaacaaaaaguuccgagaucaacuuacggggacugugccuuauuccuccauuggugaucgaaaccgccgcgcgcacucgaaagacaauagcuuguuucgaucugucuugcaaucagaccgccugucagcccacggucuuucuaaucggcccuauucagacuugcaucaccacaaagagcugucuccugggucuuggggaccaacguauucaggugaacuaugagaaaacuuacugcguuuccggacagcugguggaaggcgucuguuucaauccagugcacaccauggcauugucacagcccagucauacauaugauaucguaaccguuauggugagaugcuuucucauagucaagaaagugagcacgggcgacucuaugaagcuggagaaauccuucgagacuuuagugcaaaagacagggugcaccggaaacgguuuucagggcuacuaugucugucugguugggucaagcagugaaccucucuacauuccaacucuugaugacuauaggucugccgagauccugucccggauggcuuucgcaccgcacggagaagaucaugacguggagaagaaugccauuagcgcuaugcgcaucguaggcaaagugacagguaaggcccccucgaccgaaucuuccgauacgauccaggggauugcguuuucaggaaacccuuuguacaccaguacaggcguccuaacugcaaaagacgauccaguguacauaugggcccccggcaucauuauggaggggaaucacagcguuugcgacaagaaaacccugccucucacauggacuggauucaucccacugcccggugagauagaaaagaccacacaauguaccguguuuugcacucuugcuggcccgggggccgacugugaggcauauuccgaaacgggaauuuucaacaucucuagcccuacaugccugaucaauagaguccagagguuccggggcgcugagcagcagauuaaauuuaucugucaacgcguggauauggacauuaccguauacugcaacgguuugaagaagguuauacucacuaaaacccuggugaucgggcaguguauuuauacauucaccucaaucuuuaguuuaauccccggcgucgcccacucccuggcgguggaacuaugcgucccaggacuccauggcugggccacuaugcugcuuuugcugacauucuguuuuggguggauucucauaccuuucuuuagcaugauccugcuuaagauucugaucgcauucgcuuacuugugcucuaaauauaacacggauucaaaguuuaaaauucucaucgagaaggugaagcgagaguaccagaaaaccaugggaaguaugguuugcgaagugugucaguaugagugcgaaacugccaaggagcuggaaagccacagaaaauccugucccauagguucuugcccauacuguuuaaaucccgcugaggccacaaccucggcacugcaagcccauuucaagguaugcaaacuaacaagcagguuucaggacaaccuccggaagucccugggcgcuuacgagccuaagcagggguguuaucguacucuuucauuguuccgcuacagaaguagguuuuucgucggauucaauuggugccugcuccugguguuagaacugaucguuugggcggcaucugccgagacccagagccuuaacuccggcuggacggauaccgcucacgguucagggauuaucccaaugcggacagacuuggaacucgauuuuagccugccgucuuccgccaguuauacuuaccgacgccaacuacagaaucccgcaaacgagcaggagaaaauuccuuuccaucugcagaucagcaagcaagugauacacgccgaaauucagcaccucggccauuggauggacggaaccuuuaaucugaaaacagcuuuccacuguuauggcucuugcgagaaguacgccuauccauggcagacugcaggguguuuuaucgaaaaagauuacgaguacgaauccggaugggguugcaaucccccugacugcccaggcgucgggaccggauguacggcgugcggcguguaucuugauaaguugaagucaguagguaaagccuucaagauugugagucugagauacacaaggaaagccuguauccaauuagggaccgagcagacuugcaagagcguugacucgaacgacugucucgucacaaccuccgugaaagugugccugauaggcacugucucuaaguuucagcccagcgauacccuucuguucuugggaccgcucgagcagggcgggcugaucuuuaaacaaugguguacaacgaccugccaguucggagacccuggcgauauuaugucaacuccaguugguaugaagugucccgaacuaaguggguccuuucggaagaaaugcgcauucgccacaaccccugugugucaguuugacggaaacacacugucuggcuauaagcgcaugaucgcuacuaaagauagcuuccaguccuucaaugugaccgagccccauauuucagccagcagucucgaauggaucgacccagauucuucccugagagaccacauaaacguaauugucgguagggaucuuagcuuucaagacuugucggagacgccuugccagguggaucuggcaacaaccucaaucgacggcgcuugggggucuggaguuggcuucaauuuagugugcagugucucccucacugaauguagcaccuuucugacaucuaucaaggccugcgauagcgcgauguguuacggguccacuaccgccaaccuucugcguggacagaauacagugcacauuguuggcaaaggugggcauucaggaaguaaguucaugugcugucacgacacgaagugcagcucuaccggccuaguggcugcagcuccccaucucgaccggguaacugguuauaaccaggcugauuccgacaaaaucuuugaugacggcgccccagagugugggauuucaugcugguucacaaagaguggagaguggauacugggcgucuugaacgggaauuggauggugguggcaguccugaucgcguuauuuauuuucagcaucuuucucuucacccuguguugcccgcgaagaccuuccuacgccaaagaacacaagcccuga

SEQ ID NO: 10143 - RNA, 3447 nt, Artificial Sequence
  derived and/or modified CDS sequence (opt3) from PUUV(CG17/Baskiria-2001)__AF442614.1__GP
augggcgagcugagccccgugugccucuaccuucuguugcagggguuacugcuauguaacaccggagccgcuagaaaucucaacgaacugaagauggagugcccucacacaaucggucuuggccaagggcuggucguuggauccguggaauugccaucucucccgauucagcagguagagacucugaaacuggaaucaaguuguaauuucgaccuccauacgagcaccgcaggccagcaauccuuuacaaaguggacuugggagauaaaaggugauuuagccgagaacacccaggcgucuucgacaucauuccagaccaagagcagugaagugaaucugagggggcuuugcuugauccccacucuggucguggagacagcugcccggaugcgcaaaaccauugcauguuaugaccuauccugcaaccagacgguuugucaaccuacuguguaccucaugggaccaauccagaccugcauuacaacuaagucuugucugcuuagccugggcgaucagcgaauccaggucaauuaugaaaagaccuacugcguguccggccaauugguagaggggauauguuuuaaccccauccacacaauggcccucucacagccuagucauaccuaugacauuaugacgaugaugguucguugcuuccuggugaucaaaaaggucacuagcggagauucuaugaaaauugagaagaauuuugaaacauuagugcagaaaaacgguugcaccgcuaauaacuuccaaggcuacuauaucugucugauaggguccucaagcgagccacucuacgugcccgcacuugacgauuacagaagugccgaaguccugucuaggauggcuuuugccccucacggagaggaccaugauauugaaaagaaugcgguuuccgcaaugcggaucgccggcaaggugacugguaaagcuccaagcacagagucgucugacaccguacaggggauugccuucuccggaucaccguuguauacgaguaccggcgugcuaacaagcaaggaugaccccgucuacaucugggcaccuggcaucauuauggaggggaaccacuccauaugcgagaaaaagacucugccacucaccuggacaggauuuaucucucugcccggugaaauugagaaaacuacccaguguacaguguucugcacccuugcuggcccuggggccgauugugaagcguauagcgaaacuggaaucuuuaauauaucaaguccaacgugccugauuaaccgcguucagagauucaggggcgccgagcaacagaucaaguuugugugucagcgggucgacauggacaucacaguguacugcaacgguaugaaaaagguaauuuugaccaagacucucguuaucgggcaguguauuuauaccuucacauccauauucagccugauccccggcguggcacacucuuuagcugucgagcugugcgugccgggacuacauggcugggccaccaugcuccugcuuuugacuuuuuguuucggguggguccugauuccuacaaucacgaugauccuccugaaaauucuuauagcuuuugccuaccugugcucaaaguauaauaccgauaguaaauuccgcaucuugauugaaaaggugaaacgagaguaccaaaagacuaugggaagcaugguuugcgaagugugucaguacgagugcgaaacagcaaaggagcucgagucccacagaaaaucuuguucgaucgguagcugccccuauugucugaacccauccgaagccaccacaucagcuuuacaggcgcauuuuaagguaugcaaacugaccaguagguuccaggagaaucuacggaagucucucacugucuacgaaccuaugcaaggcuguuaucguacgcugagccuuuuucgcuacagauccagguucuuugugggguugguuuggugcgugcugcucguccuggaguuaauugugugggcagccucagcugagacccagaaccugaaugccggauggacagacacugcacacggcagcgguaucauacccaugaaaaccgaucuugaauuggacuucucucucccauccagugccagcuauacauaccggcgacagcugcagaaccccgcuaaugagcaagaaaagaucccuuuucaccuacagcugucuaagcagguaauucaugccgagauccaacaccucgggcauuggauggaugcaacuuucaaccugaaaaccgcguuucacuguuauggcuccugcgaaaaguacgcuuacccauggcagacggccggauguuucauugagaaagacuaugaguacgaaacaggcugggggugcaauccgcccgauugcccuggaguggguaccggcuguacugcaugcgggguuuaucuugacaaguugaaaucagucggaaagguguucaagaucgugagucugcgcuacacaagaaaagucuguauacaguuaggcaccgagcagacuugcaagaccguugauagcaacgacugucucauuacaacgucggugaaagugugccugaucgguaccauuuccaaguuucaaccaucugauacucuucuguucuuggggccccuccagcagggcggacugaucuuuaaacagugguguacaaccacaugccaauucggcgacccuggggacauaaugagcacuccaaccggaaugaagugucccgaacuaaauggcucauuuaggaaaaagugcgccuucgcuacgacaccgguaugucaguuugaugguaacaccaucaguggguauaagcggaugauugccacuaaagacuccuuccagucuuuuaaugucaccgagccucauaucagcacauccgcacuggaauggauugauccagacucaagccuccgcgaucacaucaacgugauaguuaguagagaccugucuuuccaggaucuuuccgagacucccugccaaauugacuuggcuaccgccagcaucgauggagcguggggcucgggugugggcuuuaaucuggucugcacagugucauuaacggaguguucugccuuccucaccaguaucaaggcuugcgacgcagccauguguuacggguccacuacagcuaaccugguuaggggacagaacaccauucacaucgugggcaaagggggacauagcggcucuaaguuuaugugcugucacgauacuaaaugcagcuccacaggucuuguagccgcagcgccucaucuggaccacgucaccggguauaaucaggccgauucagacaagauuuucgacgauggagcucccgaauguggcaugaguugcugguucaagaaaagcggugaguggauacuaggcgugcucaacgggaauuggaugguggucgccguucuggugguauugcugaucuuaucuauucuccuguuuacgcuuuguugcccacgucggccuuccuaccgaaaggaacacaaacccuga

SEQ ID NO: 10144 - RNA, 3447 nt, Artificial Sequence
  derived and/or modified CDS sequence (opt3) from PUUV(CG215/Omsk)__AF442615.1__GP
augggcaagcugagccccgugugccucuaccuucuguugcaguguuuacugcuaggggacagaggagaugccaggaaccucaaugagcugaaaauggaaugcccucacaccaucggucuuggccaagggcuggucguuggauccguggaguugccaccgguacccauucaacagguggaaucucucaagcuggagucaaguuguaacuucgaccugcauacaagcacugcuggccagcaguccuuuacgaaauggaccugggaaauaaagaaugaucucgcagagaacacacaggccucuucgacuucauuccagaccaaaagcagugaggucaauuuacggggucugugccuuaucccuacauuggugguugaaaccgcggcucgcacucgaaagacaauugccuguuaugaccugaccugcaaccagacggugugucaaccaacugucuaccuaauggggcccauccagaccugcgugacaacuaaguccugucuccugggacuuggcgaucagcguauucagguaaauuaugagaaaaccuacugcguuucuggccaacugguggaaggggucuguuuuaacccuauccacacaauggcauugagccagccaucccauaccuaugacgugaugacgcucauggugagaugcuuccugauaaucaagaaagucacuucaggagauaguaugaagauugagaaaaauuuugagacauuaguucagaagaccgguugcacuggcaacaauuuccaaggguacuauaucugucugauuggaaguucuuccgaaccccucuacgugccuacacuugacgauuacaggucagccgagguacugagccggauggcuuuugcaccacacggcgaagaccaugauaucgagaagaacgccgugaguaccaugcgcauagcugguaaagucacggggagagccccgucuaccgaagcguccgacacagugcagggaauugcauucagcggcucgcccuuguauacuucuaccggcguucuaacagccaaggaugacccuguguacaucugggcuccagggauuaucauggagggaaaucacuccucaugcgacaaaaagacucugccccucaccuggacagguuuuaucagucugccuggcgagauugaaaagaccacucaguguacggucuucugcacacuugccgggccaggagcagauugugaggcuuauagcgaaaccggcauauuuaacaucuccucucccacuugccugauuaauagggugcagcgguuccgcggugccgagcaacagaucaaguuuguaugucagcgaguugacauggauauaauuguguacugcaacgggaucaaaaaggucaucuugaccaagacacucgugauuggccaguguaucuauaccuucacuagcauuuucucacugauaccgggagucgcgcacaguuuagccguggaacugugcguuccuggccuacauggguggacaacgaugcuccugcuuuugaccuuuuguuucggaugggugcugauccccuuuauuacuaugauccuccugaaaauccuuauugcauucgcuuaccugugcuccaaguauaacacagacagcaaauuuagaauauugguagagaaggucaaaaaggaguaccaaaagaccauggguucuauggugugcgaaguuugucaguacgagugcgaaacagccaaagagcucgaaucacacaggaagaguuguagcaucggcuccugcccauauugucugaauccuucugaggcuacuaccucggccuuacaggcacauuucaaagugugcaagcugacgagccgguuucaggagaaccuacguaaaucccucaccgucuacgaacccaugcaaggguguuaucgcacacugucacuuuucagauacaggaguaaguuuuucgugggauugguauggugccugcuccuggugauggaguuaauuguuugggccgcuucugcggaaacucagaaucugaacagcggcuggaccgauacagcacacgguuccgggaucauuccaaugaagacugaccuugaguuggauuuuucacuccccagcucugccuccuauaccuaccggcgacagcugcagaauccugcuaacgagcaagagaaaaucccauuccaccuacagauaaguaagcaggucauccaugccgaaauucaacaccugggccauuggauggacgcaacguuuaaucucaaaacagccuuccacuguuauggaagcugcgaaaaguacgcuuacccguggcagaccgccggcuguuucaucgagaaagauuaugaauacgagacuggguggggaugcaaucccccugacugcccaggugugggcacaggguguaccgcaugcggaguguaucuggauaaacuuaagucugucggcaaaguuuuuaagauuguguccuugaaauacacucgcaagguguguauccagcuggguaccgagcagacaugcaaaacgguagacucaaacgacuguuuaauaaccacuagcgucaaggugugcaugauugggacaaucagcaaauuccaacccucggauacccuccuguuucuuggcccucugcagcagggaggcuugauuuucaagcagugguguacaacuaccugccaauuuggggacccaggagauaucauguccacgcccacaggcaugaaguguccggaacucaacgguucuuucaggaaaaagugcgcguuugcuaccacuccuguuugucaguucgacgggaauaccauaagcggauauaaaagaaugaucgccacaaaggauucauuucagaguuucaacgugacugagccacauauuuccgcaucugcccuggaauggaucgaccccgauagcucccuacgggaccacauuaaugucgugguuggccgcgaucugucauuucaggaccucagcgagaccccuugccaaguggaucugaugacaaguacgaucgacggugcuuggggcucugggguaggauucaaccuugucugcaccguguccuugacugaauguagccccuuucugacaucgauaaaagccugcgauucagcaauguguuacggcucuaccacugugaauuuagucagagggcagaacacaguucacauugugggaaagggcggucauaguggguccaaguucaugugcugucacgacaccaaaugcagcucuacgggacucguagcugccgcgccacaucuggacagggugacuggcuauaaccaggccgauagcgacaagaucuucgaugacggugcuccugaguguggcauguccugcugguuuaaaaagucaggggaguggauccuuggaguccugaauggcaacuggauggugguugcagugcuaauugcccuccugaucuugaguauucugauguucaccuuauguugcccccgucggccaagcuaccgaaaagaacacaagccguga

SEQ ID NO: 10145 - RNA, 3447 nt, Artificial Sequence
  derived and/or modified CDS sequence (opt3) from PUUV(CG222/Omsk)__AF442616.1__GP
augggcaagcugagccccgugugccucuaccuucuguugcaguguuuacugcuaggggacagaggagaugccaggaaccucaaugagcugaaaauggaaugcccucacaccaucggucuuggccaagggcuggucguuggauccguggaguugccaccgguacccauucaacagguggaaucucucaagcuggagucaaguuguaacuucgaccugcauacaagcacugcuggccagcaguccuuuacgaaauggaccugggaaauaaagaaugaucucgcagagaacacacaggccucuucgacuucauuccagaccaaaagcagugaggucaauuuacggggucugugccuuaucccuacauuggugguugaaaccgcggcucgcacucgaaagacaauugccuguuaugaccugaccugcaaccagacggugugucaaccaacugucuaccuaauggggcccauccagaccugcgugacaacuaaguccugucuccugggacuuggcgaucagcguauucagguaaauuaugagaaaaccuacugcguuucuggccaacugguggaaggggucuguuuuaacccuauccacacaauggcauugagccagccaucccauaccuaugacgugaugacgcucauggugagaugcuuccugauaaucaagaaagucacuucaggagauaguaugaagauugagaaaaauuuugagacauuaguucagaagaccgguugcacuggcaacaauuuccaaggguacuauaucugucugauuggaaguucuuccgaaccccucuacgugccuacacuugacgauuacaggucagccgagguacugagccggauggcuuuugcaccacacggcgaagaccaugauaucgagaagaacgccgugaguaccaugcgcauagcugguaaagucacggggagagccccgucuaccgaagcguccgacacagugcagggaauugcauucagcggcucgcccuuguauacuucuaccggcguucuaacagccaaggaugacccuguguacaucugggcuccagggauuaucauggagggaaaucacuccucaugcgacaaaaagacucugccccucaccuggacagguuuuaucagucugccuggcgagauugaaaagaccacucaguguacggucuucugcacacuugccgggccaagggcagauugugaggcuuauagcgaaaccggaauauuuaacaucuccucucccacuugccugauuaaucgggugcagcgcuuccgaggcgccgagcaacagaucaaguuuguaugucagagaguugacauggauauaauuguguacugcaacgguaucaaaaaggucaucuugaccaagacacucgugauugggcaguguaucuauaccuucacuagcauuuucucacugauaccgggcgucgcgcacaguuuagccguggaacugugcguuccuggacuacauggcuggacaacgaugcuccugcuuuugaccuuuuguuucgggugggugcugauccccuuuauuacuaugauccuccugaaaauccuuauugcauucgcuuaccugugcuccaaguauaacacagacagcaaauuuaggauauugguagagaaggucaaaaaggaguaccaaaagaccaugggaucuauggugugcgaaguuugucaguacgagugcgaaacagccaaagagcucgaaucacaccggaagaguuguagcaucgguuccugcccauauugucugaauccuucugaggcuacuaccucggccuuacaggcacauuucaaagugugcaagcugacgagccguuuucaggagaaccuacgcaaaucccucaccgucuacgaacccaugcaaggcuguuauagaacacugucacuuuucagguaccggaguaaguuuuucgugggguugguauggugccugcuccuggugauggaguuaauuguuugggccgcuucugcggaaacucagaaucugaacagcggauggaccgauacagcacacggcuccgguaucauuccaaugaagacugaccuugaguuggauuuuucacuccccagcucugccuccuauaccuaccgacgccagcugcagaauccugcuaacgagcaagagaaaaucccauuccaccuacagauaaguaagcaggucauccaugccgaaauucaacaccuggggcauuggauggacgcaacguuuaaucucaaaacagccuuccacuguuauggcagcugcgaaaaguacgcuuacccguggcagaccgccggauguuucaucgagaaagauuaugaauacgagacuggcugggggugcaaucccccugacugcccaggaguggguacaggcuguaccgcaugcgggguguaucuggauaaacuuaagucugucggaaaaguuuuuaagauuguguccuugaaauacacuagaaagguguguauccagcugggcaccgagcagacaugcaaaacgguagacucaaacgacuguuuaauaaccacuagcgucaaggugugcaugauugguacaaucagcaaauuccaacccucggauacccuccuguuucuugggccucugcagcagggcggauugauuuucaagcagugguguacaacuaccugccaauuuggcgacccaggggauaucauguccacgcccacaggaaugaaguguccggaacucaacggcucuuucaggaaaaagugcgcguuugcuaccacuccuguuugucaguucgacgguaauaccauaagcggguauaaacggaugaucgccacaaaggauucauuucagaguuucaacgugacugagccacauauuuccgcaucugcccuggaauggaucgaccccgauagcucccuacgcgaccacauuaaugucgugguuggaagagaucugucauuucaggaccucagcgagaccccuugccaaguggaucugaugacaaguacgaucgacggcgcuugggguucuggcguaggguucaaccuugucugcaccguguccuugacugaauguagcgccuuucugacaucgauaaaagcaugcgauucagcuauguguuacggaucuaccacugugaauuuagucaggggccagaacacaguucacauuguggggaagggaggccauagugguuccaaguucaugugcugucacgacaccaaaugcagcucuacggggcucguagccgcggcucccccacuggaccgugugacuggauauaaccaggccgauagcgacaagaucuucgaugacggcgcaccugagugugguauguccugcugguuuaaaaagucaggcgaguggauccuugggguccugaauggaaacuggauggugguugccgugcuaauugcucuccugaucuugaguauucugauguucaccuuauguugcccccggcgaccaagcuacagaaaagaacauaagccguga

SEQ ID NO: 10146 - RNA, 3447 nt, Artificial Sequence
  derived and/or modified CDS sequence (opt3) from PUUV(CRF161)__AF367061.1__GP
augggcaagcugagccccgugugccucuaccuucuguugcaguguuuacugcuaggggacagaggagaugccaggaaccucaaugagcugaaaauggaaugcccucacaccaucggucuuggccaagggcuggucguuggauccguggaguugccaccgguacccauucaacagguggaaucucucaagcuggagucaaguuguaacuucgaccugcauacaagcacugcuggccagcaauccuuuacgaaauggaccugggaaauaaagaaugaucucgucgagaacacacaggcaucuucgacuucauuccagaccaaaagcagugaggugaauuuacggggucugugccuuaucccuacauugguuguggaaaccgccgcgcgcacucgaaagacaauugcuuguuaugaccugaccugcaaccagacggucugucaaccaacuguguaccuaauggggcccauccagaccugcauuacaacuaaguccugucuccugggacuuggcgaucagcguauccagguaaauuaugagaaaaccuacugcguuucuggccaacugguggaaggggucuguuuuaacccuauacacacaauggccuugagccagccaucccauaccuaugacgugaugacgcucauggugagaugcuuccugaucauuaagaaagucacuucaggagauaguaugaagaucgagaaaaauuuugagacauuaguucagaagaccgguugcacuggcaacaauuuccaaggguacuauauuugucugaucggaucuagcuccgaaccccucuacgugccuacacuugacgauuacaggucagcagagguacugagccggauggccuuugcuccacacggcgaagaccaugauauagagaagaacgcagugaguaccaugcgcauugccgguaaagucgcugggagagccccgucuacggaagcguccgacaccgugcagggaaucgcauucagcggcucgcccuuguauacaucuacuggcguucuaaccgccaaggaugacccuguguacauuugggcuccagggaucaucauggagggaaaucacuccucaugcgacaaaaagacacugccccucacuuggaccgguuuuauuagucugccuggcgagauacagaaaacaacccaguguacugucuucugcacgcuugccgggccaagggcagauugucaggcuuauagcgaaacaggaaucuuuaacauuuccucuccgaccugccugaucaaucgggugcagcgcuuccgaggcgccgagcagcagauaaaguuuguaugucaaagaguugacauggauauuaucguguacugcaacgguaucaaaaaggucauuuugacuaagacccucgugaucgggcaguguauuuauacauucaccagcauauucucacugauccccggcgucgcgcacaguuuagccguggaacugugcguuccuggacuacauggcuggacuacaaugcuccugcuuuugacguuuuguuucgggugggugcugauucccuuuaucaccaugauccuccugaaaauucuuauagcauucgcuuaccugugcuccaaguauaacacugacagcaaauuuaggaucuugguagagaaggucaaaaaggaauaccagaagacaaugggaucuauggugugcgagguuugucaguacgagugcgaaaccgccaaagagcucgaaucacaccggaagaguuguagcauugguuccugcccauauugucugaauccuucugaggcuacaacuucggccuuacaagcacauuucaaagugugcaagcugaccagccguuuucaggaaaaccuacgcaaaucccucacggucuacgagcccaugcagggcuguuauagaacccugucacuuuucagguaccggaguaaguuuuucgugggguugguauggugccugcuccuggugauggaguuaaucguuugggccgcuucugcggaaacacagaaucugaacagcggauggacugauaccgcacacggcuccgguauuaucccaaugaagacagaccuugaguuggauuuuucacuccccagcucugccuccuauacuuaccgacgccaacugcagaauccugcuaacgaacaggagaaaauaccauuccaccuacaaaucaguaagcaggucauucaugccgagauccagcaccuggggcauuggauggacgcaaccuuuaaucucaaaacggccuuccacuguuauggcagcugcgaaaaguacgcuuacccguggcagacagccggauguuucauugagaaagauuaugaauacgagaccggcugggggugcaaucccccugacugcccaggaguggguacuggcuguacagcaugcgggguguaucuggauaaacuuaagucugucggaaagguuuuuaagaucguguccuugaaauacaccagaaagguguguauacaacugggcacugaacagaccugcaaaacaguagacucaaacgacuguuuaauuacgaccagugucaaggugugcaugaucgguacuauuagcaaauuccagcccucggauacacuccugauccuugggccucugcagcaaggcggauugauauuuaagcagugguguaccacaacuugccaguucggcgacccaggggauaucauguccacccccacgggaaugaaguguccggagcucaacggcucuuuuaggaaaaagugcgcguucgcuacaaccccuguuugucaguuugacgguaauacuauuagcggguauaaacggaugaucgccaccaaggauucauuccaaaguuuuaacgugacagagccacauauuuccgcaucugcccuggaauggaucgaccccgauagcucccuacgcgaccacauaaaugucgugguuggaagagaucugucauuccaggaccucagcgagacuccuugccagguggaucugaugaccaguacaauugacggcgcuugggguucuggcguaggguuuaaccuugucugcacgguguccuugaccgaauguagcgccuuccugacuucgaucaaagcaugcgauucagcuauguguuacggaucuacaaccgccaauuuagugaagggccaaaacacuguccacaugguugggaagggaggccauagugguuccaaauuuaugugcugucacgacacaaagugcagcucuaccgggcucguggcggccgcuccccaucuggacaggguaacgggauauaaccaggcagauagcgacaaaaucuucgaugacggcgccccagagugugguauguccugcugguucaagaaaucaggcgaauggauucuuggggugcugaauggaaacuggauggucguggcuguucuaaucgcccuccugauuuugaguauacugauguuuacuuuauguugcccucgucggcccagcuaccgaaaggagcacaagccauga

SEQ ID NO: 10147 - RNA, 3447 nt, Artificial Sequence
  derived and/or modified CDS sequence (opt3) from PUUV(CRF308/Omsk)__AF442617.1__GP
augggcaagcugagccccgugugccucuaccuucuguugcaguguuuacugcuaggggacagaggagaugccaggaaccucaaugagcugaaaauggaaugcccucacaccaucggucuuggccaagggcuggucguuggauccguggaguugccaccgguacccauucaacagguggaaucucucaagcuggagucaaguuguaacuucgaccugcauacaagcacugcuggccagcaguccuuuacgaaauggaccugggaaauaaagaaugaucucgcagagaacacacaggccucuucgacuucauuccagaccaaaagcagugaggucaauuuacggggucugugccuuaucccuacauuggugguugaaaccgcggcucgcacucgaaagacaauugccuguuaugaccugaccugcaaccagacggugugucaaccaacugucuaccuaauggggcccauccagaccugcauuacaacuaaguccugucuccugggacuuggcgaucagcguauccaggugaauuaugagaaaaccuacugcguaucuggccaacugguugaagggguguguuuuaacccuauacacacaauggcauugagccagccaucccauaccuaugacgucaugacgcucauggugagaugcuuccugaucauuaagaaagugacuucaggagauaguaugaagaucgagaaaaauuuugagacauuaguccagaagaccgguugcacuggcaacaauuuccaaggguacuauauuugucugaucggaucuagcuccgaaccccucuacguuccuacacuugacgauuacaggucagccgaggugcugagccggauggcuuuugcaccacacggcgaagaccaugauauagagaagaacgccguaaguaccaugcgcauugcugguaaaguggccgggagagcgccgucuacggaagcauccgacaccguccagggaaucgccuucagcggcucgcccuuguauacaucuacuggcgugcuaaccgcuaaggaugacccuguuuacauuugggccccagggaucaucauggagggaaaucacuccucaugcgacaaaaagacacugccccucacuuggaccgguuuuauuagucugccuggcgagauagaaaagacaacccaguguacuguguucugcacgcuugcagggccaggagcugauugugaggccuauagcgaaacaggcaucuuuaacauuuccucuccgaccugccugaucaauaggguccagcgguuccgcggugcggagcaacagauaaaguuugugugucagcgaguagacauggauauuaucguuuacugcaacgggaucaaaaaggugauuuugacuaagacccucgucaucggccaguguauuuauacauucaccagcauauucucacugauccccggaauugcccacaguuuagcaguggaacugugcgucccuggccuacauggguggacuacaaugcuccugcuuuugacguuuuguuucggaugggugcugauccccuuuaucaccaugauucuccugaaaauacuuaucgcuuucgccuaccugugcuccaaguauaacacugacagcaaauuuagaauuuugguugagaaggugaaaaaggaguaccaaaagacaauggguucuaugguaugcgaagucugucaguacgagugcgaaaccgcuaaagagcucgaaucacacaggaagaguuguagcaucggcuccugcccauauugucugaauccuucugaggccacaacuucggcauuacaggcccauuucaaagugugcaagcugaccagccgguuucaggagaaccuacguaaaucccucacgguuuacgaacccaugcaaggguguuaucgcacccugucacuuuucagauacaggaguaaguuuuucgugggauuggucuggugccugcuccuggugauggaguuaauuguaugggcugcgucugcagaaacacagaaucugaacagcggcuggacugauaccgcccacgguuccgggaucauaccaaugaagacagaccuugaguuggauuuuucacuccccagcucugcuuccuauacuuaccggcgacagcugcagaauccugccaacgagcaagagaaaaucccauuccaccuacagauuaguaaacaggugauccaugcagaaauucaacaccugggccauuggauggacgccaccuuuaaucucaaaacggcuuuccacuguuauggaagcugcgaaaaguacgccuacccguggcagacagcaggcuguuucaucgagaaagauuaugaauacgagaccggguggggaugcaaucccccugacugcccagguguuggcacuggguguacagcgugcggagucuaucuggauaaacuuaagucugugggcaaaguguuuaagauagucuccuugaaauacacccgcaagguuuguauucagcuggguacugagcagaccugcaaaacaguggacucaaacgacuguuuaaucacgaccagugugaagguaugcaugauugggacuaucagcaaauuccaacccucggauacacuccuguuucuuggcccucugcagcagggaggcuugauauucaagcagugguguaccacaacuugccaauuuggggacccaggagauaucauguccacccccacgggcaugaaguguccggaacucaacgguucuuucaggaaaaagugcgcuuuugccacaaccccugucugucaguucgacgggaauacuauuagcggauauaaaagaaugaucgcaaccaaggauucauuucagaguuucaacgugacagagccacauauuuccgccucugcucuggaauggaucgaccccgauagcucccuacgggaccacauaaauguuguggucggccgcgaucugucauuucaggaccucagcgagacuccuugccaaguggaucugaugaccaguacaauugacggugccuggggcucugggguuggauucaaccuugugugcacgguauccuugaccgaauguagcgcauuucugacuucgaucaaggcuugcgauucagccauguguuacggcucuacaaccgcgaauuuagucagagggcagaacacugugcacaucgugggaaagggcggucauaguggguccaaguucaugugcugucacgacacaaaaugcagcucuaccggacucgucgccgcugcaccccaucuggacaggguuacgggcuauaaccaggccgauagcgacaagauuuucgaugacggugcuccagaguguggcauguccugcugguuuaaaaagucaggggaguggauccuuggagugcugaauggcaacuggaugguaguggccguccuaauugcacuccugauauugaguauccugauguucacuuuauguugcccucgucggcccagcuaccgaaaagaacacaagccauga

SEQ ID NO: 10148 - RNA, 3447 nt, Artificial Sequence
  derived and/or modified CDS sequence (opt3) from PUUV(Mu/07/1219)__KJ994777.1__GP
auggagaagaucauucccgugugccuguaccucccuuuccuuugucuguuguuauggagcagaggcgacaccaggaaccugaaugaacuaaaaauggagugcccacacacaauagggcucggacagggucuggucaucggcuccauugaacuuccgcccguuccucugauccaaguggagucuuugaagcucgaaucaaguuguaacuuugaucugcauacuagcacguccucucagcaggccuucaccaaauggacaugggagguaaagucggaccuggcugagaauacucaggcaucaagcaccaguuuucaaacaaaauccucugaagugaaccuccggggguuaugccuggucccaccccuugugauugagaccgccgcgcgcacucgaaagacaaucgcuuguuucgauuugagcugcaaucagaccacgugucagccuacuguuuuucugaugggaccaauacagaccugcaucacaacuaaguccugucuacucggccugggugaccaacguauucaggugaacuaugaaaagaccuacugcgucucagggcagcuuaucgagggaauuuguuucaaucccgugcacacaauggcccugagucagccuagccauaccuaugauaucguaacgguuauggugagaugcuuuuugauagucaagaaagugacuacaggcgacucuaugaagauugagaaauccuucgaaacccucgugcaaaagacuggcugcacagauaacggguuucagggauacuaugucugucugaucgguucaagcagugagccauuauacauuccgacccuggacgauuauaggucugcagaaguucucucccggauggccuucgcuccccacggcgaggaccaugauaucgaaaagaaugcaaucagcgccaugcgcauuguggggaaaguaacgggaaaggcuccuucgaccgagucuuccgacacagugcagggcauagccuuuucagguaacccacuuuacacuagcaccgggguccugacagcgaaagaugaccccguguacguuugggcaccuggaaucaugauggagggcaaucacagcgugugcgaaaagaaaacuuugccacuaaccuggacaggcuucauuccccugccgggggagaucgaaaagaccacucaauguacggucuuuugcacacucgccggaccuggugcugacugugaggccuauuccgaaaccggcauauucaacauuucuagccccacuugccugaucaauagagugcagagguuccgcggggcagagcagcagaucaaauuuauuugucaacggguagauauggacaucaccguuuacugcaacggacuuaagaaggugauucugacaaaaaccuuggucauaggccaguguaucuauacuuucacaucaauuuuuagucucaucccagguguggcucacucccuggccgucgaguuaugcgugccugggcugcauggcugggcgacgaugcuacuccugcuuaccuucuguuuuggauggaucuugauucccuucuuugccaugauacugcucaagguucugaucgcacuugcuuaccugugcagcaaauauaauacugauucuaaguucaaaguguugauugaaaagguaaagaaagaguaccagaagacaaugggcucaauggucugcgaagugugucaguaugagugcgaaaccgccaaagagcucgagagucaccgaaagagcuguccaaugggguccugccccuacugucugaacccugcugaagccacaacuucugcauuacaagcccauuuuaaaguuugcaagcugaccucgagauuccaggacaaccuaaggaagagucucggagcuuacgagccaaaacaggguuguuaucggacgcugucccuuuuucguuaccgcucaagauucuuugugggcuucaucuggugcuugcugcucguccuggaauuaauugugugggcggcaagugccgagacccagaaucugaacucuggguggacagauacugcucacggaagcggcguaaucccgaugaggaccgaccuugaguuggauuucucccuccccucaagcgccucuuauacauaccggcgacaacugcagaauccugcaaacgaacaggagaagauaccauuucaccuacagaucuccaaacaagugauucaugccgaaauccagcaccugggucauuggauggacgggacuuucaaucucaagaccgcuuuucacuguuauggcaguugcgagaaauacgccuaucccuggcagacggcaggauguuucguugaaaaggauuacgaguacgagagcggcugggggugcaacccugcggacugcccaggagucgguacaggcuguaccgcuugcgggguguaucuggauaaacuuaaaucugugggaaaggccuuuaaaauugucuccuugcgcuacacuagaaaggcauguauccaacugggcacagaacagaccugcaaaaauguugacucaaacgacuguuuagugacuaccagugugaagguaugccucauagguacagucagcaaauuccagcccucggauacgcugcuuuuucuggggccguuggagcagggcggacucauuuucaagcaaugguguaccacuacaugccaguuuggcgacccuggggauaucauguccaccccagugggaaugaagugucccgaacugucuggcagcuucaggaaaaagugcgccuuugcuacaacuccuguuugucaguucgacgguaauaccauuucaggguauaaacggaugaucgccacgaaggauaguuuucaguccuucaacgugacagagccccauauaucugcaagcucccuagaauggaucgacccagauucaagccugcgcgaccacauuaaugucaucgugggaagagaucucaguuuccaagaccugucugagaccccuugccagguugaucuuacuaccacauccauugacggcgcuugggguagcggcgugggguuuaacuugaucugcucgguaucacugacugaguguucuaccuucuuaacaaguauaaaagccugcgauuccgcgauguguuacggaagcacgaccgccaaucucgucaggggccagaacacugugcacauuguggggaagggaggccauucugguagcaaguuuaugugcugucacgacacaaaaugcuccucaaccgggcuggucgcugcagcuccccaucuugaccguguuacuggauauaaucaggccgauagugacaagaucuucgaugacggcgccccagaaugugguaucagcugcugguuuacaaaaucuggcgaguggauucugggggugcuaaacggaaacuggaugguaguggcaguccucguggcgcuguucaucuuguccauuuuucuguucaccuuauguugcccgcggcgaccuucauacgccaaggaacacaaacccuga

SEQ ID NO: 10149 - RNA, 3447 nt, Artificial Sequence
  derived and/or modified CDS sequence (opt3) from PUUV(Puu/Kazan)__Z84205.1__GP
augggcaagcugagccccgugugccucuaccuucuguugcagggguuacugcuauucaacaccggaacagccagaaaucucaacgagcugaaaauggaauguccucacacuaucggucuuggccaagggcuggucguuggauccguggaguugccaccgguacccauucaacagguggaaacgcucaagcuggagucuucaugcaauuuugaccugcauaccaguacagcuggccagcaagcauucacuaaauggaccugggaaauaaagggugaucucgccgagaacacacaggcgagcuccaccucuuuucagacuaaaucgucagaggucaauuuaagggggcugugucuuaucccuacauuggugauugaaaccgcugcccggaugcgcaagacgaucgcaugcuaugaccugagcuguaaccagacuguuugccaaccaaccguguaccuaaugggacccauucagacauguaucacuaccaagaguugccuccugggccuuggcgaucagcgaauacaggucaauuaugagaaaacauacuguguguccgggcaacugguagaaggaguuugcuucaacccuauccacaccauggccuugucucagccaagccauacguaugacauugugacuaugaugguccguuguuuucucgugaucaagaaagugacauccggugauucaaugaagauugagaaaaauuucgagacccugguccagaagaacggcugcacugcuaauaguuuucaaggguacuauaucugcuuaauaggaucuagcuccgaaccccuguacguuccuacacucgacgauuacagaucagcagaggugcuuagcaggauggccuucgcuccacacggcgaagaccaugauguagagaagaacgccauuagugcgcugcggaucgcagguaaagugaccgggaaggccccgucuacggaauccagcgacaccguccagggaguggcuuuuucgggcucucccuuguauacauccacuggcguucuaaccgccaaagaugacccuguguacauuugggcaccagggaucaucauggagggaaaucacucagucugugagaagaaaacacugccccucacuuggaccgguuucauuagucugccuggcgaaauagagaagacaacccagugcacuguguuuuguacgcuugcugggccaggagccgauugcgaagcguauagcgagacaggcaucuucaacauuuccucucccaccugucugaucaaucgcguacagagauuuaggggugccgaacaacagauaaaauucguuugccagcggguggacauggacauuacugucuacuguaacggggugaagaaggucaucuugaccaaaacacucgugaucggccagugcauuuauaccuucacuagcaucuuuucacugauuccgggaguugcacacaguuuagcuguggagcuguguguaccuggccuacaugggugggccacaaugcuccugcuuuugacguucugcuuuggauggguccugauacccaccaucacuaugauucuccugaagauccuuaucgcuuucgccuaccuguguuccaaauauaacacagauagcaaguuucgcauuuugauagagaaagugaagaaggaauaccagaaaaccauggguucuaugguuugcgaggugugccaguacgaaugugagacagcaaaggaacucgagucacaccgaaaaaguugcagcaucggcuccuguccauauugccugaauccuucugaggccacuaccucggcuuuacaggcgcauuucaaggucuguaaacugacgagcaggauucaggaaaaccuaagaaagucccucaccguguacgagcccaugcaagggugcuaucggacacugucacuuuuucguuaccgcaguagauucuuuguaggauuggugugguguguucugcucguccuggaauuaaucgugugggcagccucugcugagacucagaaucugaacgccggcuggaccgacacagcacacgguagcgggauuaucccaaugaagacugaucuugaguuggacuucucccuccccucaagcgccucuuauaccuacaggcggcagcugcagaauccugcuaacgaacaagagaauauaccauuucaccuacagaucuccaaacaggugauucaugccgaaauccaacaccugggccauuggauggaugcaacguucaaccucaagacagcguuucacugcuauggaaguugugagaaauacgcuuacccguggcagaccgccggcugcuucgucgaaaaggacuaugaguacgagacuggguggggauguaaucccccugauugcccagguguuggcacagggugcaccgcauguggagccuaucuggacaaacuuaagagcgugggcaagguguucaaaauuguaucuuugcgauacacucgcaaggucugcauccagcuggguaccgaacagacauguaaaacgguggauuccaacgacugcuuaauaaccacuucaguuaaggugugucucauugggacaaucaguaaauuucaacccagcgauacccugcuuuuccugggcccuuugcagcagggaggccucauuuuuaagcaguggugcacaacuaccugucaauucggggacccaggagacaucaugucgacgcccacaggcaugaaaugcccggaucugaaugguuccuuuagaaagaagugugcuuucgccaccacuccugucugccaguuugacgggaacaccauaucuggauauaaaaggaugaucgcaacaaaggauagcuuccagucauuuaaugugacugagccacauauuagugcuuccgcccuagaauggaucgaccccgauucuagccugcgggaccacauuaacguuaucgugucccgcgaucucucauuccaggaccugagcgagaccccuugucaaauagaucuuaguacagcgucuauugacggcgccugggguuccggcguaggguuuaauuuggucugcacggugagccugaccgaaugcucggcuuucuuaacuucaaucaaagcaugugaugccgcuaugugcuacggaucuacaaccgccaaccucgugagaggccagaacacuauccacauugucgggaagggaggccauagugguuccaaauuuauguguugccacgacacaaaguguagcaccacggggcugguugcagcggcuccccaucuugauagggugacuggauauaaucaggccgacucugacaagaucuucgaugacggcgccccagagugcgguaugagcuguugguucaaaaaguccggcgaguggauucuggggguacuaaacggaaauuggaugguggucgcagugcucauagcucuguugauccugucaauuuuacucuuuacccugugcuguccucgucggcccaguuaccgaaaagaacacaagccauga

SEQ ID NO: 10150 - RNA, 3447 nt, Artificial Sequence
  derived and/or modified CDS sequence (opt3) from PUUV(PUUV/Ardennes/Mg156/2011)__KT247603.1__GP
augggcaagaucauucccgugugccuguaccuccuuuuccuguguuuguuacugugggacagaggggauaccaggaaccuaaaugagcucaaaauggaaugcccucacacaauaggacugggucagggccuugucaucgggagcguugagcugccaccggugcccuugacucaaguagaaucccucaagcuggagucuucauguaacuuugaccugcauacgaguaccagcucccagcagucuuucacaaaauggacuugggaaaugaagguggaucucgccgagaauacccaggcuucgucaaccagcuuucaaacaaaaaguuccgagauuaacuuacggggacugugccuugucccuccauuggugaucgaaacugcagcccgcacacgaaagaccauugcguguuucgaccugucuugcaaucagacggcuugucagcccacuguuuuucuaaucggcccuauacagaccugcaucacaacuaagagcugucuccugggucuuggggaucaacguauucaggugaacuaugagaaaaccuacugcgucuccggacagcugguggaaggcaucuguuucaauccaguacacacaauggccuugucacagcccagucauaccuaugacauuguuacggugauggucagaugcuuucucaucgugaagaaagugagcacuggcgauucuaugaagcuggagaaauccuucgagacauuaguccaaaagaccgggugcacuggaaacgguuuucagggcuacuauguuugucugauagggucaagcagugaaccucucuacauuccaacacuugacgauuauaggucugcagaggugcugucccggauggccuucgcuccgcacggagaagaccaugauaucgagaagaaugcaauuagcgccaugcgcaucguaggcaaagugaccgguaaggcucccucgacggaaucuuccgacaccguccaggggaucgccuuuucaggaaacccuuuguacacaaguacuggcgugcuaaccgcgaaagaugacccaauuuacauaugggcacccggcaucauuauggaggggaaucacagcguuugcgacaagaaaacacugccucucacuuggaccggauucaucccacugcccggugagauagaaaagacaacccaauguacuguguuuugcacgcuugccggcccgggggcugauugugaggccuauuccgaaacaggaauuuucaacaucucuagcccuaccugccugaucaauagaguccagagguuccggggcgcagagcagcagauuaaauuuaucugucaacgcguggacauggauauuacuguauacugcaacgguuugaagaagguuauacucaccaaaacacuggugaucgggcaguguauuuauaccuucacuucaaucuuuaguuuaauccccggcgucgcucacucccuggccguggaacuaugcgucccaggacuccauggcugggcgacaaugcugcuuuugcugacguucuguuuuggguggauucucauaccuuucuuuagcaugauccugcuuaagauucugaucgccuucgcauacuugugcucuaaauauaauaccgacucaaaguuuaaaauucucaucgagaaggugaagaaagaguaccagaagacuaugggaaguaugguuugcgaagugugucaguaugagugcgaaacagcuaaagagcuggaaagccaccgaaaguccugucccauggguucuugcccauacuguuuaaaccccgccgaggcuaccacaucggcccugcaagcacauuucaaaguaugcaagcuaacuagcagauuucaggauaaccucaggaagucccugggcgccuacgagccuaaacagggguguuaucggacccuuucauuguuccguuaccgcaguagauuuuucgucggauucauauggugcuuucugcucgugcuggaauuaaucguuugggcugcgucugcagagacgcagaaucugaacagcggcuggaccgacacagcccacgguuccgggauuaucccaaugaggacugaucuugaauuggacuucucacucccgagcucugcuuccuauaccuaccggcgacaacugcagaaucccgccaacgagcaggagaagauuccuuuucaccuacagaucaguaaacaagugauacaugcagaaauucagcaccugggccauuggauggauggaacauucaaucucaagacugccuuucacuguuauggcagcugcgagaaauacgcuuauccauggcagaccgccggguguuucgucgaaaaggacuacgaguacgaaucuggaugggguugcaaucccccugauugcccaggcguggggacgggauguacagcaugcggcguauaucuggacaaacuuaaauccguggguaaggcguuuaaaaucguuucauugcgcuacaccagaaaggcuuguauucaacuggggacugagcagacaugcaaaagugucgacagcaacgauuguuuagugaccacuucggugaaggucugccucaucggcaccguuuccaaauuccagcccucugacacacugcuuuuucugggaccguuggagcagggcgggcucauauucaagcaaugguguacgaccacuugccaguuuggagauccuggcgacaucaugagcacaccaguggguaugaagugucccgaacugucagggaguuucaggaaaaagugcgccuuugcaaccacaccugugugucaguucgauggaaacacucuauccggcuauaaacggaugauugccaccaaggacucuuuccagagcuuuaauguaacggagccccauaucuccgcuucaagccuggaauggauugauccagacaguucucuccgcgaucacaucaacgucauaguggguagagaccuguccuuccaagaucuuagcgagacaccuugccagguugacuuggccaccucgucaauugauggcgcaugggggucuggagugggcuuuaaucuggucugcaguguguccuuaacugaauguagcaccuuccucacaucuaucaaggcuugcgacagcgccauguguuacggguccacuaccgcgaaccugcuuaggggacagaauacaguucacaucgugggcaagggugggcauucaggaaguaaguuuaugugcugucacgacacgaaaugcagcucuaccggccugguagccgcugcaccccaucuagaucgugucacugguuauaaccaggccgacuccgauaagauuuucgacgauggcgcuccagagugugggaucucaugcugguuuacaaaaaguggagaguggauucucggcgugcugaaugggaacuggaugguggucgccguuuugguggcacuguucauauuaagcaucuuucucuucacccuguguugcccgcggcgaccuuccuacgcgaaggaacacaaacccuga

SEQ ID NO: 10151 - RNA, 3447 nt, Artificial Sequence
  derived and/or modified CDS sequence (opt3) from PUUV(PUUV/Ardennes/Mg75/2011)__KT247602.1__GP
augggcaagaucauucccgugugccuguaccuccuuuuccuguguuuguuacugugggacagaggggauaccaggaaccuaaaugagcucaaaauggaaugcccucacacaauaggacugggucagggccuugucaucgggagcguugagcugccaccggugcccuugacucaaguagaaucccucaagcuggagucuucauguaacuuugaccugcauacgaguaccagcucccagcagucuuucacaaaauggacuugggaaaugaagguggaucucgccgagaauacccaggcuucgucaacaucuuuucaaaccaaaaguuccgagauuaacuuacggggacugugccuugucccuccauuggugaucgaaacugcagcccgcacacgaaagaccauugcguguuucgaccugucuugcaaucagacggcuugucagcccacuguuuuucuaaucggcccuauacagaccugcaucacaacuaagagcugucuccugggucuuggggaucaacguauucaggugaacuaugagaaaaccuacugcgucuccggacagcugguggaaggcaucuguuucaauccaguacacacaauggccuugucacagcccagucauaccuaugacauuguuacggugauggucagaugcuuucucaucgugaagaaagugagcacuggcgauucuaugaagcuggagaaauccuucgagacauuaguccaaaagaccgggugcacuggaaacgguuuucagggcuacuauguuugucugauagggucaagcagugaaccucucuacauuccaacacuugacgauuauaggucugcagaggugcugucccggauggccuucgcuccgcacggagaagaccaugauaucgagaagaaugcaauuagcgccaugcgcaucguaggcaaagugaccgguaaggcucccucgacggaaucuuccgacaccguccaggggaucgccuuuucaggaaacccuuuguacacaaguacuggcgugcuaaccgcgaaagaugacccaauuuacauaugggcacccggcaucauuauggaggggaaucacagcguuugcgacaagaaaacacugccucucacuuggaccggauucaucccacugcccggugagauagaaaagacaacccaauguacuguguuuugcacgcuugccggcccgggggcugauugugaggccuauuccgaaacaggaauuuucaacaucucuagcccuaccugccugaucaauagaguccagagguuccggggcgcagagcagcagauuaaauuuaucugucaacgcguggacauggauauuacuguauacugcaacgguuugaagaagguuauacucaccaaaacacuggugaucgggcaguguauuuauaccuucacuucaaucuuuaguuuaauccccggcgucgcucacucccuggccguggaacuaugcgucccaggacuccauggcugggcgacaaugcugcuuuugcugacguucuguuuuggguggauucucauaccuuucuuuagcaugauccugcuuaagauucugaucgccuucgcauacuugugcucuaaauauaauaccgacucaaaguuuaaaauucucaucgagaaggugaagaaagaguaccagaagacuaugggaaguaugguuugcgaagugugucaguaugagugcgaaacagcuaaagagcuggaaagccaccgaaaguccugucccauggguucuugcccauacuguuuaaaccccgccgaggcuaccacaucggcccugcaagcacauuucaaaguaugcaagcuaacuagcagauuucaggauaaccucaggaagucccugggcgccuacgagccuaaacagggguguuaucggacccuuucauuguuccguuaccgcaguagauuuuucgucggauucauauggugcuuucugcucgugcuggaauuaaucguuugggcugcgucugcagagacgcagaaucugaacagcggcuggaccgacacagcccacgguuccgggauuaucccaaugaggacugaucuugaauuggacuucucacucccgagcucugcuuccuauaccuaccggcgacaacugcagaaucccgccaacgagcaggagaagauuccuuuucaccuacagaucaguaaacaagugauacaugcagaaauucagcaccugggccauuggauggauggaacauucaaucucaagacugccuuucacuguuauggcagcugcgagaaauacgcuuauccauggcagaccgccggguguuucgucgaaaaggacuacgaguacgaaucuggaugggguugcaaucccccugauugcccaggcguggggacgggauguacagcaugcggcguauaucuggacaaacuuaaauccguggguaaggcguuuaaaaucguuucauugcgcuacaccagaaaggcuuguauucaacuggggacugagcagacaugcaaaagugucgacagcaacgauuguuuagugaccacuucggugaaggucugccucaucggcaccguuuccaaauuccagcccucugacacacugcuuuuucugggaccguuggagcagggcgggcucauauucaagcaaugguguacgaccacuugccauuuuggagauccuggcgacaucaugagcacaccagugucaaugaagugucccgaacugagugguuccuucaggaaaaagugcgccuuugcaaccacaccugugugucaguucgaugggaacacucuaucuggauauaaacggaugauugccaccaaggacagcuuccaguccuuuaauguaacggagccccacaucucagcuagcagucuggaauggauugauccagacucuucccuccgcgaucacaucaacgucauagugggcagagaccugagcuuccaggaucuuucggagacaccuugccaaguugacuuggccaccucaucuauugauggugcauggggcaguggggugggauuuaaucuggucugcuccgugagcuuaacugaauguucuaccuuccucacaagcaucaaggcuugcgacuccgccauguguuacggcucaacuaccgcgaaccugcuuagggggcagaauacaguucauaucgugggaaagggcggucacagugggagcaaguuuaugugcugucaugacacgaaaugcagcuccaccggacugguagccgcugcaccccaccuagaucgugucacuggcuauaaccaggccgacucagauaagauuuucgacgauggugcuccagaguguggcaucaguugcugguuuacaaaaagcggggaguggauucucggagugcugaauggcaacuggaugguggucgccguuuugguggcacuguucauauuauccaucuuucucuucacccuguguugcccgcggcgaccuucuuacgcgaaggaacacaaacccuga

SEQ ID NO: 10152 - RNA, 3447 nt, Artificial Sequence
  derived and/or modified CDS sequence (opt3) from PUUV(PUUV/Jura/Mg2/2010)__KT247598.1__GP
augggcaagaucauucccgugugccuguaccuccuuuuccuguguuuguuacuguggaacagaggggacaccaggaaucuaaacgagcucaaaauggaaugcccucacacaauaggacugggucagggccuugucaucgggagcguugagcugccaccggugcccuugacucaaguagaaucccucaagcuggagucuucauguaauuuugaucugcauacgaguaccagcucccagcagucuuucacaaaauggacuugggaaaugaagucggaccucgccgagaacacccaggcuucaagcacaaguuuucaaaccaaauccucugagauuaauuuacggggacugugccuugugccuccauuggucaucgaaacugcagcccgcacacgaaagaccauugcguguuucgaucugagcugcaaccagacggcuugucagcccacuguguuucuaaucggcccuauacagaccugccucacaacuaaguccugucugcuuggucugggggaccaacguauccagguuaauuaugagaaaaccuacugcgugucaggacaguuggucgaaggcguguguuucaacccaauucacacaauggcccucagucagcccagccauaccuaugauaucguaacgguuauggugagaugcuuucugauugucaagaaagugucuacuggcgacuccaugaagaucgagaaaucauucgagacauuagugcaaaagaccgggugcacuggaaaugguuuucagggcuacuaugucugucugauagggagcaguucugaaccucucuacauuccaacacuugaugacuauagguccgcagagguucugagccggauggccuucgcuccgcacggagaagaucaugacaucgagaagaacgcaauuucggccaugcgcaucgugggcaaaguaaccgguaaggcucccucuacggaauccucagauaccgugcaggggaucgccuuuaguggaaauccuuuguacacaagcacuggcguccuaaccgcgaaagacgauccaauuuacauaugggcacccggcaucauuauggaggggaaccacuccgugugcgagaagaaaacacugccucucacuuggaccggauucaucccacugcccggugaaauagagaagacaacccaauguacuguguuuugcacgcuugccggcccgggggcugacugugaagccuauucugagacaggaauuuucaauaucagcucaccuaccugccugaucaacagaguucagagguuccggggcgcagaacagcagauuaaauuuaucugucaacgcgucgacauggauauuacuguguacugcaaugguuugaagaagguaauacucaccaaaacacugguuaucgggcaguguauuuauaccuucacaaguaucuuuuccuuaauccccggcguggcucacagccuggccgucgagcuaugcgugccaggacuccauggcugggcgacuaugcugcuuuugcugacguucuguuuuggguggauucucauaccuuucaccgccaugcugcuucugaagaucuugauugcauuugcuuaccucugcucuaaauauaacacugacucaaaguucaaaauccugauugagaaggucaagaaagaauaccagaagacaaugggaaguauggugugcgagguuugucaguaugaaugcgagaccgccaaagaauuagagagccaccgaaaguccugucccauggguucuugcccauacugucugaaccccgcugaggccacaacuucggcacuacaagcccauuuuaaagugugcaagcucaccagcagauuccaggauaaucugaggaagucccuuggcgcuuacgaaccuaaacagggguguuaucggacguugucacuguuucguuaccgcaguagauucuuuguaggacucgucuggugcuuccuguuagugcuggagcuuaucauaugggcggcaucugccgaaacccagaacuugaauagcggcuggacagacacugcucacgguuccgggguuaucccaaugaggaccgaucucgagcuggacuucucacuaccgagcucugccuccuauacauaccggcgacaacugcagaaccccgcaaaugagcaggaaaagauuccuuuucaccuccagaucaguaaacaagugauucaugccgagauccagcaccugggccauuggauggauggaacuuucaaccuuaagaccgcuuuucacuguuauggcagcugcgaaaaauacgccuauccauggcagacggcaggguguuucgucgagaaggacuacgaauacgagucuggaugggguugcaaucccccugauugcccaggcguggggacaggauguaccgcgugcggcguauauuuggacaagcugaaauccguggguaaggcuuuucgcauaguuucauuaaaauacacuagaaaggccuguauucaacucgggacagagcagaccugcaaaagugucgauagcaacgacugucuggugacuaccucggugaaggucugccuuaucggcacaguuuccaaauuccagcccucugacacgcuguuguuucucggaccgcuggaacagggcgggcuaauuuucaagcaaugguguaccacuacaugccaguuuggagauccuagggacaucaugagcaccccagugggcaugcggugucccgagcugucagguaguuuccgcaagaaaugcgcauuugccacaacuccugugugucaguucgaugggaauaccauauccggauauaagagaaugaucgcuacgaaagacucuuuucagagcuucaacguaacagaaccccauauuuccgccucaagccucgaguggaucgauccagacaguucucugagggaucacauuaaugucaucgugggccgugaccuuuccuuccaagauuugagcgaaaccccuugccagguugaccugacuaccacaucgauagauggugcauggggcucaggggugggauuuaacuuaauuugcucugucagucucacugaguguuccaccuuccugacaagcaucaaggcuugcgacucugccauguguuacggcagcacgaccgcgaaucuuaugcgggggcagaacacuauccacauugugggaaaaggcggucauuccgggucaaaguuuaugugcugucacgauacaaagugcaguagcaccggacugguugccgcugcaccccaucuagaccgagugacuggcuauaaucaggccgacucugauaaaaucuucgacgauggugcuccagaguguggcauuuccugcugguuuacaaagucaggggaauggauacucggaguacugaacggcaacuggauggucguggccguguuggucguucuguucaucuuaaguauuuuucucuucacccuguguugcccgagaaggccuagcuacgcaaaagagcacaagcccuga

SEQ ID NO: 10153 - RNA, 3447 nt, Artificial Sequence
  derived and/or modified CDS sequence (opt3) from PUUV(PUUV/Jura/Mg214/2010)__KT247599.1__GP
augggcaagaucauucccgugugccuguaccuccuuuuccuguguuuguuacuguggaacagaggggacaccaggaaucuaaacgagcucaaaauggaaugcccucacacaauaggacugggucagggccuugucaucgggagcguugagcugccaccggugcccuugacucaaguagaaucccucaagcuggagucuucauguaauuuugaucugcauacgaguaccagcucccagcagucuuucacaaaauggacuugggaaaugaagucggaccucgccgagaacacccaggcuucaagcacaaguuuucaaaccaaauccucugagauuaauuuacggggacugugccuugugccuccauuggucaucgaaacugcagcccgcacacgaaagaccauugcguguuucgaucugagcugcaaccagacggcuugucagcccacuguguuucuaaucggcccuauacagaccugccucacaacuaaguccugucugcuuggucugggggaccaacguauccagguuaauuaugagaaaaccuacugcgugucaggacaguuggucgaaggcguguguuucaacccaauucacacaauggcccucagucagcccagccauaccuaugauaucguaacgguuauggugagaugcuuucugauugucaagaaagugucuacuggcgacuccaugaagaucgagaaaucauucgagacauuagugcaaaagaccgggugcacuggaaaugguuuucagggcuacuaugucugucugauagggagcaguucugaaccucucuacauuccaacacuugaugacuauagguccgcagagguucugagccggauggccuuggcuccgcacggagaagaucaugacaucgagaagaacgcaauuucggccaugcgcaucgugggcaaaguaaccgguaaggcucccucuacggaauccucagauaccgugcaggggaucgccuucaguggaaauccucuauacacaagcacuggcguccugaccgcgaaagacgauccaauuuacauaugggcacccggcaucauuauggaggggaaccacuccgugugcgagaagaaaacacucccucugacuuggaccggauuuaucccacuucccggugaaauagagaagacaacccaauguacuguuuucugcacgcuggccggcccgggggcugacugugaagccuauucugagacaggaauuuuuaauaucagcucaccuaccugcuugaucaacagagugcagagguuccggggcgcagaacagcagauuaaauucaucugucaacgcgucgacauggauauuacuguguacugcaauggucucaagaagguaauacugaccaaaacauuaguuaucgggcaguguauuuauaccuuuacaaguaucuucucccugauccccggcguggcucacagccuagccgucgagcucugcgugccaggacugcauggcugggcgacuaugcuuuugcugcucacguuuuguuucggguggauucugauaccuuuuaccgccaugcuucuguugaagauccucauugcauucgcuuaccugugcucuaaauauaacacugacucaaaguuuaaaaucuuaauugagaaggucaagaaagaauaccacaagaguaugggaagcauggugugcgagguuugucaguaugaaugcgagacagccaaagaacuggagucccaucgaaagucuugucccauggguucgugcccauacugucuaaaccccgcugaggccaccacaagcgcacuccaggcccacuucaaagugugcaagcugacuuccagauuucaagauaaucuuaggaagucauugggcgcuuacgaaccuaaacagggguguuaucggacccugagucucuuccguuaccgcucuagauuuuucguaggacuggucuggugcuuuuuacuggugcuugaguugaucauaugggcggcaagcgccgaaacgcagaaccucaauuccggcuggaccgacacagcucacgguucagggguuaucccaaugaggacugaucuggagcuagacuucagccugccgucuuccgccaguuauaccuaccggcgacagcuccaaaaccccgcaaaugagcaggaaaagauuccuuuccaucugcagaucagcaaacaggugauucacgccgagauccaacaucuuggccacuggauggauggaacauuuaacuugaagacugcuuuccauuguuauggcucuugcgaaaaauacgccuauccauggcagaccgcaggguguuuugucgagaaggacuacgaauacgaguccggaugggguugcaaucccccugauugcccaggcguggggacgggauguacagcgugcggcguauaucuggacaaguuaaaaucaguggguaaggcuuuccgcauaguuagucucaaauacaccagaaaggccuguauucagcuggggacugagcaaacaugcaaaagcgucgauucgaacgacugucuugugaccacuuccgugaaggucugccugaucggcaccguuucuaaauuucagcccagcgacacacucuuguuccugggaccgcuagaacagggcgggcugauuuuuaagcagugguguacgaccacuugccaauucggagauccuggcgacaucaugucaacaccaguggguaugaggugucccgagcucaguggguccuuucggaagaaaugcgcauucgccaccacaccugugugucaguuugauggaaauacuauaucuggcuauaagcgcaugaucgcuaccaaagacagcuuccaguccuuuaacguaacggaaccccacauuucagccagcagucuggaguggaucgauccagacucuucccuuagagaucacauuaaugucaucguggguagggacuugagcuuccaggaucugucggaaacaccuugccaaguugacuuaaccacuaccucaauagauggcgcaugggggucuggagugggcuucaaccucauuugcagugucucccugacagaguguagcacuuuucuuaccucuaucaaggcuugcgacagcgccauguguuacggguccacaacggcgaaucugaugcguggacagaacaccauccauauugugggcaaaggugggcacucaggaaguaaguucaugugcugucaugauacuaagugcagcucuacaggccuaguugccgcugcaccccaccucgaccgggugaccgguuauaaucaggccgacuccgauaaaaucuuugacgauggcgcuccagagugugggauuucaugcugguucacuaagaguggagaauggauacugggcguauugaacgggaacuggauggucguggccgugcuggucguuuuauuuauccucagcauuuuccuguuuacacuuuguugcccgcgaagaccuuccuacgcaaaagagcacaagcccuga

SEQ ID NO: 10154 - RNA, 3447 nt, Artificial Sequence
  derived and/or modified CDS sequence (opt3) from PUUV(PUUV/Orleans/Mg23/2010)__KT247600.1__GP
augggcaagaucauucccgugugccuguaccuccuuuucagaugucuguuguuaugggacagggggaacgcccggaaucugaacgagcuaaaaauggaaugcccucacaccauaggacucggucagggccuggucaucgggagcguugagcuuccaccggugccccugacacaaauugaauccuugaagcucgagucuucauguaauuuugaucugcauacuucaacgagcucccagcagucuuucaccaaauggacaugggaaaucaagucggaccuggcugagaacacucaggcaucaagcaccaguuuucaaacaaaauccucugagguaaaucuccgcggauuaugccuggugccuccacuugucauugaaaccgccgcgcgaacucguaagacaaucgcuuguuucgauuugagcugcaaccagaccgccugucagcccacgguguuucugauaggcccuauccagacuugcauuaccacaaaguccugucuacucggucugggggaccaaagaauccagguuaauuaugagaaaacuuacugcgugucaggacagcuuauugaaggcaucuguuucaacccaguccacaccauggcacugagucagcccagccauacauaugaugugguaaccguuauggugaggugcuuuuugauagucaagaaagugucuacgggcgacuccaugaagauugagaaaucauucgagacucucgugcaaaagacagggugcaccggaaaugguuuucagggcuacuaugucugucugaucgggagcaguucugaaccuuuauacauuccaacucuggaugacuaucgguccgccgagguucucagccgcauggcuuucgcaccgcacggagaagaucaugacaucgagaagaacgccaucucggcuaugagaauugugggcaaaguaacagguaaggcccccucuaccgaagcguccgauacggugcaggggauagcauuuucaggaaauccucuuuacaccaguacaggcguccugacugccaaagacgauccaaucuacauuugggcucccggcaucauaauggaggggaaccacagcgugugcgagaagaaaaccuugccucuaacauggacuggauucauuccacugcccggugaaaucgagaagaccacacaauguaccguguuuugcacucucgccggcccgggggcagacugugaggcuuauuccgaaacgggaaucuucaauauuucuagcccuacaugccugaucaacaggguucagcgguuccgcggcgccgaacagcagauuaaauuuauaugucaacgagucgacauggauaucaccguguacugcaauggucuuaagaagguaauucugacuaaaaccuucaucaucgggcaguguauuuauacauuuaccucaauauucaguuugauccccggcguugcgcacucccucgccguggagcugugcgucccaggauuacauggcugggcaacuaugcugcuacuccugacauuuuguuucgggugggugcuuauucccuuuuucagcaugaucuugcugaagauucucaucgcuuuugccuaccugugcucuaaauauaacacggacucaaaguucagaauacuuaucgagaaagucaagagggaauaccagaagaccaugggaaguauggugugcgagguuugucaguaugaaugcgagacugcuaaagaacuggagagccaccggaaguccuguccuauggguucuugcccauacuguuugaaccccgccgaggcaacaaccucggcccuccaagcucauuuuaaagugugcaagcugacaagccguuuccaggauaauuuacgcaaaucccugggcgcguacgaaccuaagcagggguguuauagaacucuaucacucuuuagguaccggagucgauucuucguaggauuuauuuggugcuuccugcuugucuuggagcugaucauuugggcagccucugcugaaacccagaaccucaauagcggcuggacggacaccgcccacgguuccggggugaucccaaugcgcacagaucuggaguuagacuuuucacugccgagcucugcauccuauacuuacagaaggcaacuucagaaccccgccaaugagcaggaaaagauaccuuuccacuugcagauuaguaaacaaguuauccaugcugagauucagcaccucggccauuggauggauggaaccuuuaaccugaagacagccuuccacuguuauggcagcugcgaaaaauacgcauauccauggcagacugcgggguguuuuaucgagaaggacuacgaauacgagucuggaugggguugcaaucccccugauugcccaggcguggggaccggauguacggcuugcggcgucuaucuagacaaacugaaguccguggguaaggccuucaaaauaguaucacuccgguacacacgcaaggcauguauccaacuggggaccgagcagacuugcaaaaguguggauagcaacgacugucuuguuacaaccucggucaaggugugcuugauuggcacuguguccaaauuucagcccucugacacccuguuauuccucggaccgcuggaacagggcgggcuuaucuuuaagcaaugguguacaacgaccugccauuucggagauccuggcgacauuaugagcacuccagccgguaugaaaugucccgagcugucagggaguuuuacaaagaagugcgcuuucgccccuacccccgucugucaguucgauggagacacaacuuccggcuauaaaaagaugaucgcaaccaaagauucuuuucagagcuucaauguuacggaaccacacauauccgcuaguagcuuggaguggauugacccugauagaagucucagggaccacaucaacgugaucgugggucgugaucugucuuuucaggaccuauccgaaacacccugccaaguagaucugaccacuaccagcauugacggcgccugggggucgggagucggcuucaaucucaucugcucagugucucugacagaguguaguacuuuucuuaccuccauuaaggcgugcgauagcgccauguguuacgggucuacaacggcuaacuugcugcggggacagaauaccguucauauagugggcaaaggugggcacagcggauccaaguucaugugcugucaugacacuaagugcucaaguacaggcuuagucgcagccgcuccacaccucgaccgagugaccgguuauaaccaggccgauagcgacaaaaucuuugaugacggcgcaccggagugugggauuucuugcuggcugacuaaguccggagaauggauccuuggcguucugaaugggaacuggauggugguagcgguccuaguggcccucuucaucuuuucaauuuuccuguuuacauuguguugcccuagaaggcccaguuacgcuaaagagcacaagccauga

SEQ ID NO: 10155 - RNA, 3447 nt, Artificial Sequence
  derived and/or modified CDS sequence (opt3) from PUUV(PUUV/Orleans/Mg29/2010)__KT247601.1__GP
augggcaagaucauucccgugugccuguaccuccuuuucagaugucuguuguuaugggacagggggaacgcccggaaucugaacgagcuaaaaauggaaugcccucacaccauaggacucggucagggccuggucaucgggagcguugagcuuccaccggugccccugacacaaauugaauccuugaagcucgagucuucauguaauuuugaucugcauacuucaacgagcucccagcagucuuucaccaaauggacaugggaaaucaagucggaccuggcugagaacacucaggcaucaagcaccaguuuucaaacaaaauccucugagguaaaucuccgcggauuaugccuggugccuccacuugucauugaaaccgccgcgcgaacucguaagacaaucgcuuguuucgauuugagcugcaaccagaccgccugucagcccacgguguuucugauaggcccuauccagacuugcauuaccacaaaguccugucuacucggucugggggaccaaagaauccagguuaauuaugagaaaacuuacugcgugucaggacagcuugucgaaggcguguguuucaacccaauucacaccauggcacugagucagcccagccauacauaugauaucguaaccguuauggugaggugcuuuuugauagucaagaaagugucuacgggcgacuccaugaagauugagaaaucauucgagacucucgugcaaaagacagggugcaccggaaaugguuuucagggcuacuaugucugucugaucgggagcaguucugaaccuuuauacauuccaacucuggaugacuaucgguccgccgagguucucagccgcauggcuuucgcaccgcacggagaagaucaugacaucgagaagaacgccaucucggcuaugagaauugugggcaaaguaacagguaaggcccccucuaccgaagcguccgauacggugcaggggauagcauuuucaggaaauccucuuuacaccaguacaggcguccugacugccaaagacgauccaaucuacauuugggcucccggcaucauaauggaggggaaccacagcgugugcgagaagaaaaccuugccucuaacauggacuggauucauuccacugcccggugaaaucgagaagaccacacaauguaccguguuuugcacucucgccggcccgggggcagacugugaggcuuauuccgaaacgggaaucuucaauauuucuagcccuacaugccugaucaacaggguucagcgguuccgcggcgccgaacagcagauuaaauuuauaugucaacgagucgacauggauaucaccguguacugcaauggucuuaagaagguaauucugacuaaaaccuucaucaucgggcaguguauuuauacauuuaccucaauauucaguuugauccccggcguugcgcacucccucgccguggagcugugcgucccaggauuacauggcugggcaacuaugcugcuacuccugacauuuuguuucgggugggugcuuauucccuuuuucagcaugaucuugcugaagauucucaucgcuuuugccuaccugugcucuaaauauaacacggacucaaaguucagaauacuuaucgagaaagucaagagggaauaccagaagaccaugggaaguauggugugcgagguuugucaguaugaaugcgagacugcuaaagaacuggagagccaccggaaguccuguccuauggguucuugcccauacuguuugaaccccgccgaggcaacaaccucggcccuccaagcucauuuuaaagugugcaagcugacaagccguuuccaggauaauuuacgcaaaucccugggcgcguacgaaccuaagcagggguguuauagaacucuaucacucuuuagguaccggagucgauucuucguaggauuuauuuggugcuuccugcuugucuuggagcugaucauuugggcagccucugcugaaacccagaaccucaauagcggcuggacggacaccgcccacgguuccggggugaucccaaugcgcacagaucuggaguuagacuuuucacugccgagcucugcauccuauacuuacagaaggcaacuucagaaccccgccaaugagcaggaaaagauaccuuuccacuugcagauuaguaaacaaguuauccaugcugagauucagcaccucggccauuggauggauggaaccuuuaaccugaagacagccuuccacuguuauggcagcugcgaaaaauacgcauauccauggcagacugcgggguguuuuaucgagaaggacuacgaauacgagucuggaugggguugcaaucccccugauugcccaggcguggggaccggauguacggcuugcggcgucuaucuagacaaacugaaguccguggguaaggccuucaaaauaguaucacuccgguacacacgcaaggcauguauccaacuggggaccgagcagacuugcaaaaguguggauagcaacgacugucuuguuacaaccucggucaaggugugcuugauuggcacuguguccaaauuucagcccucugacacccuguuauuccucggaccgcuggaacagggcgggcuuaucuuuaagcaaugguguacaacgaccugccauuucggagauccuggcgacauuaugagcacuccagccgguaugaaaugucccgagcugucagggaguuuuagaaagaagugcgcuuucgccccuacacccgucugucacuucgauggaaaaaccaucuccggcuauaagaggaugauagcaacaaaagacucuuuucagagcuucaauguuacugaaccacacauuuccgcuaguagcuuggaguggaucgauccugacaguucucuccgugaucauaucaacgugauugugggucgggaccuguccuuucaggaucuaagcgaaacccccugccagguagaccugacgacaaccucgaucgauggcgccugggggucaggagucggcuucaaucucauuugcucugugagucugacugaguguuccaccuuucuuacaagcauaaaggcgugcgacucugccauguguuacgggagcacuaccgcuaacuugcugcgaggacaaaauacaguucacaucgugggcaaaggugggcauuccggaucaaaguucaugugcugucacgauacgaagugcaguagcaccggcuuagucgcagccgcuccacaccucgacagagugacugguuauaaccaggccgacucugauaaaauuuuugacgauggcgcaccggagugugggaucuccugcuggcugacaaagucaggagaauggauucuuggcguucugaaugggaacuggauggugguagcgguccuaguggcccucuucaucuuuaguauauuccuguuuaccuuguguugcccuaggcgccccagcuacgcuaaagagcauaagccauga

SEQ ID NO: 10156 - RNA, 3447 nt, Artificial Sequence
  derived and/or modified CDS sequence (opt3) from PUUV(Vranica)__U14136.1__GP
augggcaagcugagccccgugugccucuaccuuuuccugcaguguuuguuacuguggaacagaggguccgccaggaaucuaaacgagcucaaaauggaaugcccucacaccaucggacugggucaaggccuugucauugggucuguugagcugccaccggugcccauacagcagguagaaucauugaagcucgagaguagcuguaauuuugaccugcauacauccacugcuacgcagcaaucuuucaccaaauggacaugggaaaugaaggaugaccuggcagagaacacucaggccucgucaaccagcuuucagacaaaaaguuccgaggugaaucuccggggauuaugccugaucccuccacuugucguggaaaccgcgucucgcacucgaaagacaauugcuuguuucgauaucagcugcaaccagaccguuugucaacccacgguguauuuggucggcccuauucagacuugcaucaccacaaaguccugucugcuaggucucggggaccagcguauacaggugaauuacgagaaaacuuauugcguaucaggacaacugaucgaaggcguuuguuuuaacccagugcacaccagagcccuuagucagcccagccauacauacgauauugucaccaugauggugaggugcuuccugguggucaagaaaguuacgucuggcgacuccaugaagaucgagaaaaauuuugagacuuuggugcagaagacagauugcaacgcaaauggguuccaaggauauuacauuugucucguagguucaagcagugaaccucuguaugugccaaccuuagacgauuaccggucugccgagguccugucccgcauggcuuuugcaccgcacggcgaagaccaugauguggagagaaacgccguuagcgcucucaggaucguggggaaggucacuggaaaagcccccucgacagaagcgucugacaccgugcagggcauagcauucuccgguucaccucuuuacacgaguaccgggguacugacagccaaggauaauccaguuuauauuuggagccccggaaucauuauggagggcaaccacuccgugugcgagaaaaagacuuugccucuaaccuggacaggcuuuaucccacugcccggggaaaucgagaaaacuccgcaguguaccgucuucugcacacucgcuggaccuggugccgacugugaagcauacucugagaccggcauuuuuaauauaagcucacccacuugccugcuuaaccgggugcagcgcuuccgaggggcugaacaacagaucaaguucgucugucagagaguggacauggauauuacgguuuauugcaacggaaugaaaaaggugauccugacaaagaccuugguaauaggccaguguauuuacacuuuuaccaguaucuucucccucaucccagguauugcccacagccuggcggucgaguuaugcgugccugggcugcauggcugggccacaguucuacuccugcuuaccuuuuguuucggauggaucuugauucccuuuauagcaaugauccugcucaaaauucugaucgcuuucgccuaucuuugcucuaaguacaauacugacucaaaauuuaagauccugauugagaaagugaagaaggaauaucagaaaacaaugggcaguauggucugcgaggugugucaauacgaaugcgagacggcuaaggaauuggagagccacaggaaauccuguccaauagggucuugccccuacugucucaacccuucggaggccaccacuagcgcacugcaggcccauuucaagguaugcaaauuaacaucccgguuucaggauaaucugcguaagucacuagcugcguaugaaccaaagcaaggauguuaccgcacccucagucuguucagauauaggucucgguuuuucguggguuuuaucuggugcauucuuuugguucuggagcucgucaucugggcagccagcgcugaaacacagaaccugaauaguggcuggacugacaccgcccacgggucaggaguggugccgaugcgaacggauuuagagcuggacuucagccuucccucuuccgcaaguuacaccuaucgcagacaguugcagaacccugccaaugagcacgagaaaauuccauuccaucuccaaaucagcaagcaggucauacacgcugaaauccagcaucugggccacuggauggaugccacauuuaaccuaaaaacugcauuccauuguuacggucugugcgaaaaguaugcguaccccuggcaaaccgcugggugcuuuuucgagaaagacuacgaauuugagucuggcuggggauguaauccuccagauugccccggcauugggacaggauguacugccugcgguguuuaucucgacaagcugaaguccgugggcaaaguguucaagaucauuucacuuagguacacccggaaagcauguauccaguuggggacggagcagacaugcaagaguguagauagcaacgacugucuggucaccacuucgauaaaagugugcuuaauuggaacaguuuccaaguuucagccgucugacacccuccuguuccuuggcccucuggaacaagguggguugaucuuuaaacagugguguacuaccacaugccaguucggcgauccaggagacauuaugagcacgcucaccggcaugaagugucccgagcugaaugggucauuucgcaagaaaugcgccuucgcuacuacaccugugugucaguuugauggaaacaccaucaguggcuauaagagaaugauggccacaaaagacuccuuccaaucuuucaaugucacugaaccccacauaagcaccuccgcacuagaguggaucgauccagacucaagccugagggaucacauuaacgugguugugagucgugaccucucuuuucaggaucuguccgaaacgccuugccagguagaccuuacaaccagcucgaucgauggugcuugggggucaggagucggcuucaauuuggugugcacugugucucugaccgagugucccacauuuuuaacuuccauuaaggccugcgacuccgcgauguguuacgguagcaccacaacgaaccucguccggggccagaacaccguucauaucguggggaaaggaggccacucugggagcaaguucaugugcugucaugauacuaagugcuccucaacaggacugauagccgcugcaccacaccuugaccgaguaaccggcuuuaaucaagccgacagugauaaaauuuucgacgauggugcuccgggguguggaaugagcugcugguuuaagaaaucuggcgaguggauccugggugugcuaaacggcaauuggcucgucguggccguucugaucgcauuguucauucuguccaucuuuuuauucacucucuguugcccuagaaggcccacauauaccaaggaacacaaaccauga

SEQ ID NO: 10157 - RNA, 3447 nt, Artificial Sequence
  derived and/or modified CDS sequence (opt3) from PUUV(CG1820/POR)__KT885051.1__GP
augggcgagcugagccccgugugccucuaccuucuguugcagggguuacugcuauguaacaccggagccgcuagaaaucucaacgaacugaagauggagugcccucacacaaucaggcuuggucaaggccuggucguuggguccguggaauugccaucucucccgauucagcagguagagacucugaaacuggaaucaaguuguaauuucgaccuccauacgagcaccgcaggacagcaauccuuuacaaaguggacuugggagauaaaaggcgauuuagccgagaacacccaggcgucuucgacaucauuccagaccaagagcagugaagugaaucugcggggucuuugcuugauccccacucuggucguggagacagcugcccgcaugcgaaaaaccauugcauguuaugaccuauccugcaaccagacgguuugucaaccuacuguguaccucauggggccaauccagaccugcauuacaacuaagucuugucugcuuagccugggagaucagcguauccaggucaauuaugaaaagaccuacugcguguccggccaauugguagagggcauauguuuuaaccccauccacacaauggcccucucacagccuagucauaccuaugacauuaugacgaugaugguuagaugcuuccuggugaucaaaaaggucacuagcggggauucuaugaaaauugagaagaauuuugaaacauuagugcagaaaaacggaugcaccgcuaauaacuuccaagguuacuauaucugucugauaggcuccucaagcgagccacucuacgugcccgcacuugacgauuacaggagugccgaaguccugucucggauggcuuuugccccucacggggaggaccaugauauugaaaagaaugcgguuuccgcaaugcgcaucgccggaaaggugacuggcaaagcuccaagcacagagucgucugacaccguacaggguauugccuucuccgggucaccguuguauacgaguaccggagugcuaacaagcaaggaugaccccgucuacaucugggcaccuggcaucauuauggagggcaaccacuccauaugcgagaaaaagacucugccacucaccuggacaggguuuaucucucugcccggagaaauugagaaaacuacccaguguacaguguucugcacccuugcugguccuggcgccgauugugaagcguauagcgaaacugggaucuuuaauauaucaaguccaacgugccugauuaacagaguucagagguuccggggauccgagcaacagaucaaguuugugugucagcgcgucgacauggacaucacaguguacugcaacggcaugaaaaagguaauuuugaccaagacucucguuaucggucaguguauuuauaccuucacaagcauauucucucugauccccgggguggcccacucauuagcagucgagcugugcgugccgggccuacauggaugggcuaccaugcuccugcuuuugacuuuuuguuucggcuggguccugauuccuacaaucacgaugauccuccugaaaauucuuauagccuuugcuuaccugugcaguaaguauaauaccgauagcaaauuccgaaucuugauugaaaaggugaaaagagaguaccaaaagacuaugggguccaugguuugcgaagugugucaguacgagugcgaaacagccaaggagcucgagucucacaggaaaucguguagcaucggauccugccccuauugucugaacccaucagaagcaaccacaagugccuuacaggcucauuuuaagguaugcaaacugacuucucgguuccaggagaaucuacguaagagccucaccgucuacgaaccuaugcaagguuguuaucgcacgcugucccuuuuuagauacaggucacgguucuuugugggcuugguuuggugcgugcugcucguccuggaguuaauugugugggcggcaagcgccgagacccagaaccugaaugcuggguggacagacacugcccacggaucuggcaucauacccaugaaaaccgaucuugaauuggacuucucccucccaaguagcgcaucuuauacauaccgacgccagcugcagaaccccgccaaugagcaagaaaagaucccuuuucaccuacagcuguccaagcagguaauucaugcugagauccaacaccucggucauuggauggaugccacuuucaaccugaaaaccgcauuucacuguuaugggucaugcgaaaaguacgcguacccauggcagacggcuggcuguuucauugagaaagacuaugaguacgaaacaggauggggcugcaauccgcccgauugcccuggggugggaaccgguuguacugccugcggcguuuaucuugacaaguugaaaagugucgggaagguguucaagaucgugagccugagauacacaaggaaagucuguauacaguuaggaaccgagcagacuugcaagaccguugauucgaacgacugucucauuacaacguccgugaaagugugccugaucggcaccauuucuaaguuucaaccaagcgauacucuucuguucuuggguccccuccagcaagggggccugaucuuuaaacagugguguacaaccacaugccaguucggagacccuggcgacauaaugucaacuccaaccgggaugaagugucccgaacuaaauggaaguuuucggaaaaagugcgcauucgccacgacaccgguaugucaguuugauggcaacaccaucuccgguuauaagcgcaugauugcuacuaaagacucuuuccagagcuuuaaugucaccgagccucauaucuccacaucagcccuggaauggauugauccagacagcagucucagagaucacaucaacgugauaguuucuagggaccuguccuuccaggaucuuagcgagacucccugccaaauugacuuggcaaccgcuucgaucgauggggccuggggaucaggcguggguuuuaaucuggucugcacagugucuuuaacggaguguagugcguuccucaccuccaucaaggccugcgacgcugcaauguguuacggcagcacuacagccaaccugguucgugggcagaacaccauucacaucgugggaaaaggcgggcauucuggaagcaaguuuaugugcugucacgauacuaaaugcuccucaacaggccuuguagcugccgcaccucaucuggaccgggucaccgguuauaaucaggcggauagugacaagauuuucgacgauggggcccccgaauguggaaugagcugcugguucaagaaaucuggcgaguggauacuaggugugcucaacggcaauuggaugguggucgcuguucuggugguauugcugaucuuauccauucuccuguuuacgcuuuguugcccacgaagaccuucauacaggaaggaacacaaacccuga

SEQ ID NO: 10158 - RNA, 3447 nt, Artificial Sequence
  derived and/or modified CDS sequence (opt3) from PUUV(DTK/Ufa-97)__AB297666.2__GP
augggcgagcugagccccgugugccucuaccuucuguugcagggguuacugcuauguaacaccggagccgcuagaaaucucaacgaacugaagauggagugcccucacacagucaggcuuggucaaggccugguugugggguccguagaauugccaucucucccgauccaacagguggagacucugaaacuggaaucaaguuguaauuucgaccuccauacgagcaccgcaggacagcaguccuuuacaaaguggacuugggagauuaaaggcgauuuagccgagaacacccaggcgucuucgacaucauuccagaccaagagcagugaagucaaucugcggggucuuugcuugauacccacucuggugguugagacagcugcccgcaugcgaaaaaccaucgcauguuaugaccuauccugcaaccagacggugugucaaccuacugucuaccucauggggccaauucagaccugcaucacaacuaagucuugucugcuuagccugggagaucagcguauucaggugaauuaugaaaagaccuacugcguauccggccaauugguugagggcaucuguuuuaaccccauacacacaauggcccucucacagccuagucauaccuaugacaucaugacgaugauggugagaugcuuccuggucauuaaaaaggugacuagcggggauucuaugaaaaucgagaagaauuuugaaacauuagugcagaaaaacggaugcaccgcuaauaacuuccaagguuacuauauuugucugaucggcuccucaagcgagccacucuacguccccgcacuugacgauuacaggagugccgaaguucugucucggauggcuuuugccccucacggggaggaccaugauauagaaaagaaugcgguguccgcaaugcgcauugccggaaagguaacuggcaaagcuccaagcacagagucgucugacaccgugcaggguaucgccuucuccgggucaccguuguauacgaguaccggaguccuaacaagcaaggaugaccccguguacauuugggcaccuggcaucaucauggagggcaaccacuccauuugcgaaaagaagacucugccacucaccuggacaggguuuauaucucugcccggagagaucgagaaaacuacccaguguacaguuuucugcacccuugcugguccuggcgccgauugugaagcguauagcgaaacugggauuuuuaauaucucaaguccaacgugccugauaaacagagugcagagguuccggggauccgagcaacagauuaaguuugucugucagcgcguggacauggacaucacaguauacugcaacggcaugaaaaagguuaucuugaccaagacucucgugauuggucaguguaucuauaccuucacaagcauuuucucucugauacccggggucgcccacucauuagcaguggagcugugcgucccgggccuacauggaugggcuaccaugcuccugcuuuugacuuuuuguuucggcugggugcugaucccuacaauuacgaugauccuccugaaaauccuuauugccuuugcuuaccugugcaguaaguauaauaccgauagcaaauuccgaauauugaucgaaaagguuaaaagagaguaccaaaagacuaugggguccauggugugcgaaguaugucaguacgagugcgaaacagccaaggagcucgagucucacaggaaaucguguagcauuggauccugccccuauugucugaacccaucagaagcaaccacaagugccuuacaggcucauuuuaaggucugcaaacugacuucucgguuccaggagaaucuacguaagagccucaccguguacgaaccuaugcaagguuguuaucgcacgcugucccuuuuuagauacaggucacgguucuuuguuggcuugguguggugcguccugcucgugcuggaguuaaucguaugggcggcaagcgccgagacccagaaccugaaugcuggguggacagacacugcccacggaucuggcauuauccccaugaaaaccgaucuugaauuggacuucucccucccaaguagcgcaucuuauacauaccgacgccagcugcagaaccccgccaaugagcaagaaaagauaccuuuucaccuacagcuguccaaacaggugauccaugcugagauucaacaccucggucauuggauggaugccacuuucaaccugaaaaccgcauuucacuguuaugggucaugcgaaaaguacgcguacccauggcagacggcuggcuguuucaucgagaaagacuaugaguacgaaacaggauggggcugcaauccgcccgauugcccugggguuggaaccgguuguacugccugcggcgucuaucuugacaaguugaaaaguguggggaagguguucaagauugucagccugagauacacaaggaaaguuuguauccaguuaggaaccgagcagacuugcaagaccguggauucgaacgacugucucauaacaacguccgugaaaguaugccugauuggcaccaucucuaaguuucaaccaagcgauacucuucuguucuuggguccccuccagcaagggggccugauuuuuaaacagugguguacaaccacaugccaguucggagacccuggcgacaucaugucaacuccaaccgggaugaagugucccgaacuaaauggaaguuuucggaaaaagugcgcauucgccacgacaccggucugucaguuugauggcaacaccauauccgguuauaagcgcaugaucgcuacuaaagacucuuuccagagcuuuaaugugaccgagccucauauuuccacaucagcccuggaauggaucgauccagacagcagucucagagaucacauuaacguuaucgugucuagggaccuguccuuccaggaucuuagcgagacucccugccaaauagacuuggcaaccgcuucgauugauggggccuggggaucaggcgucgguuuuaaucuggugugcacaguuucuuuaacggaguguagugcguuccucaccuccaucaaggccugcgacgcugcaauguguuacggcagcacuacagccaaccuggugcgugggcagaacaccauccacauuguaggaaaaggcgggcauucuggaagcaaguuuaugugcugucacgauacuaaaugcuccucaacaggccuugucgcugccgcaccucaucuggaccgggugaccgguuauaaucaggcggauagugacaagaucuucgacgauggggcccccgaauguggaaugagcugcugguucaagaaaucuggcgaguggauucuaggugugcucaacggcaauuggauggucguugcugugcugguaguguugcugauauuauccauccuccuguuuacgcuuuguugcccacgaagaccuucauacaggaaggaacacaaacccuga

SEQ ID NO: 10159 - RNA, 3447 nt, Artificial Sequence
  derived and/or modified CDS sequence (opt3) from PUUV(PUU/Cg-Erft)__AJ238778.1__GP
augggcaagaucauucccgugugccuguaccuccuuuuccuguguuuguuacuguggaacagaggggacgccaggaaucuaaacgagcucaaaauagaaugcccucacaccaucggacugggucagggccuugucauugggagcguugagcugccaccggugcccuugacacaaguagaaucccucaagcuggagucuucauguaauuuugaucugcauacgaguacuagcucccagcagccuuucaccaaauggacaugggaaaugaagucugaccucgcugagaacacucaggcaucgucaaccagcuuucaaacaaaaaguuccgagaucaauuuacggggacugugccuugugccacccuuggucauugaaaccgccgcgcgcacucgaaagacaaucgcuuguuucgaucugucuugcaaccagaccgccugucagccuacgguguuucuaauaggcccaauccagacuugcauuaccacaaagagcugucuccugggucuuggggaccaacguauccagguuaauuaugagaaaacuuacugcguguccggacagcuggucgaaggcguguguuucaaccccguacacaccauggcauugucacagccuagucauacauaugauauuguuaccgugauggucagaugcuuucucaucgccaagaaagugagcacgggcgacucuaugaagcuggagaaauccuucgagacuuuagugcaaaagacaucaugcaccgggaauggauuucaggguuacuauauaugucuggucggcagcaguucugaaccacucuacauuccgacucuugaugacuauagguccgcugagguucugagccggauggcauucgcuccccacggggaagaucaugacguggagaagaacgccaucucggccaugcgcauuaucggaaaaguaacaggcaaggcgccuucuaccgaauccucagauacgauccaggguguggcauuuagugggaauccauuguacaccagcacaggaguccuaacugccaaagacgaucccguguacauuugggcuccuggcauaaucauggagggcaaccacuccguuugcgacaagaaaacccugccacucacauggacuggguucauuccccugccgggagagaucgaaaagaccacacaauguaccguguuuugcacucuugccgguccuggcgcagacugugaggcuuauucugaaacggggauauucaauauuagcucacccacaugccugaucaacagaguccagagguuccggggagccgagcagcagaucaaauuuauuugucaacgcguggauauggacaucaccguauacugcaauggcuugaagaagguuauucucacuaaaacccugauaaucggucaguguauuuauacauucaccaguaucuuuuccuuaaucccagggguggcgcacagccuggccgucgaacuaugcgugccuggccuccauggaugggcaacuaugcugcuuuugcugacauucuguuuuggcuggauucucauacccuucuuuucuaugauccugcuuaagauucugaucgcuuucgccuacuugugcucaaaauauaacacggauaguaaguuuaaaauucucaucgagaaggucaagaaagaguaccagaagaccauggggagcauggugugcgaaguuugucacuaugagugcgaaacugcuaaagagcuggaaucccaucgaaagucuuguccaaugggaucgugccccuacuguuuaaacccugccgaggcaacaaccagcgcccugcaggcucacuucaaagugugcaagcuaacauccagauuucaagacaaucucaggaagucacugggugcguacgagccaaaacagggcuguuaucggacucuuaguuuguuccguuaccgcucuagauuuuucguaggguucauauggugccugcuccuggucuuagaacugaucgugugggcagccagcgcugagacccagaaccuuaauuccggauggacggauaccgcccacggcucagguauuaucccgaugaggacagacuuggaacucgauuuuagccugcccucuuccgcaaguuauacuuaccggcgacagcuacaaaacccugccaaugagcaggagaagauuccauuccaucugcagaucagcaaacagguuauacacgcugaaauucaacaucucgggcacuggauggacggcaccuuuaaccugaagacagccuuccauuguuauggaucuugcgagaaauacgcauaucccuggcagacugcgggcuguuuuaucgaaaaggauuacgaguacgaauccggguggggaugcaauccuccagacugccccggugugggcaccggguguacggcuugcggagucuaucuugauaaguugaaaucagugggcaaggccuucaaaauuguaagucugcgcuacacaagaaaggcauguauccaguuagguaccgagcaaacuugcaaaagcguggacucgaacgacugucucguuacaaccuccgucaaggugugccugauagggacugugucuaaauuucagccgagcgauacccuucuguucuugggcccucucgagcagggaggccugaucuuuaagcagugguguacaacgaccugccaauucggggacccaggagauauuaugucaacucccgucggcaugaaguguccugaacuaaaugguaguuuuaggaaaaagugcgccuucgcuacaacccccguuugucaguuugacgggaacacacuguccggauauaaacggaugaucgccacuaaggauucuuuccagagcuucaaugugaccgagccacacauuuccgcaucaagccucgaauggaucgacccugauaguucucugcgcgaccacauaaacgugauuguaggcagagaucuuuccuuucaggacuugagcgagacgcccugccaagucgaucuggcuacaaccucgaucgacggugccuggggcucaggggugggauucaauuuaguuugcucugugagucucacugaauguuccaccuuucugacaagcaucaaagcgugcgauucugccauguguuacggcagcacuaccgcuaaccuucugagggggcagaauacaguccauauugugggaaagggcggucacuccgggucaaaguucaugugcugucaugacacgaaaugcaguagcaccggccuaguugcagccgcuccacaccucgaccgugugacuggauauaaccaggccgauucugacaagaucuuugaugacggugcaccggaguguggcauuuccugcugguucacaaaaucaggggaguggauacugggaguauugaacggcaauuggauggucguggcggugcuggucgccuuauuuauccucaguauuuuccuguuuacccuuuguugcccucggcgacccagcuacgcuaaggaacacaaaccauga

SEQ ID NO: 10160 - RNA, 3447 nt, Artificial Sequence
  derived and/or modified CDS sequence (opt3) from PUUV(PUUV/Konnevesi/Mg_M105A/2005)__JQ319173.1__GP
augggcaagagcucccccgugugccuguaccucauccuucaggggcuguuguuaauuggagccgucaacgcuagaaaucugaacgagcuaaaaauggaauguccucacaccauaggucucggccaagggcugguugugggaucuguagagcuuccaccggugcccauccagcaggucgaaucacugaaguuggagaguagcugcaauuucgaccuccauacauccacugcaggccagcaaucuuuuacgaaauggaccugggaaacaaagucggaucuggccgagaacacucaggcgucaagcaccaguuuccagacaaaauccucugaggugaaucugaggggucucuguuuaauuccuacccugguuguggaaacugcugcccggaugcgcaagacaaucgcaugcuaugaccuuagcuguaaccagaccgucugccaaccaacgguguacuugauggggcccauucagacuugucugaccacaaaguccugccuacucggacugggcgaucagcgaauccagguaaauuaugagcguacuuacuguguuucaggccaacuuguggaaggggucugcuuuaacccuauacacaccauggcccugagucagccaagccauacauaugacaucgugaccgugauggucagauguuucuugguuauuaaaaaggugacgucuggagauuccaugaaaaucgagaagaauuuugagacucucguacagaaaacagguugcaccgcuaacucauuccaaggcuacuauauuugccugguggggagcaguucugaacccuuauacgucccuacucuggacgauuacagguccgcagaggugcucagccggauggccuuugcuccacacggagaagaccaugauaucgagaagaaugccauaucggcgcuucgcauugcaggcaagguuacagguaaagccccgucuaccgaauccucagacacggugcaggggaucgcuuucaguggaagcccccuguauaccuccacaggcgucuugacugccaaggaugacccuguguacauuugggcaccaggcaucaucauggaggggaaccacucuguaugugagaaaaagacccuaccccugacauggacuggauuuauuccucucccaggugaaauagagaaaaccacacagugcaccguuuucuguacucuggcuggccccggggccgauugcgaagcguauagcgagacgggaaucuuuaauauuucaaguccgacaugucuuaucaacagagugcagagguuccggggcgccgaacaacagauaaaguuugucugccagcgcguggacauggacauuaccgucuacuguaauggugugaaaaagguuauccugacuaagaccuuggugaucgggcagugcauuuauacauucaccuccaucuucagccucauuccuggcauagcacacucucuggcuguagaguuauguguccccggacugcauggcugggccacugugcuacuccugcuuacauuuugcuucggguggguuuugaucccaacgauuaccaugauccugcucaaaauccugauugcuuuugccuaccuuuguucaaaguauaacacugauaguaaauucaagauacugguggagaaagucaagaaggaauaccagaaaacaaugggaagcauggugugcgagguaugccaauacgaaugugagaccgcaaaggaauuggagucccaccgaaaaucuugcucgaucgguagcuguccuuauugccucaaccccuccgaggccacaccaucagcucugcaggcgcauuuuaagguguguaaauuaaccaguagauuccaggaaaaucugaagaagucucuaacuauguacgagcccaugcaaggcugcuauaggacgcucagccuguuucgguaccguucccgcuucuuuguugggcuugucugguguauguugcuggugcucgaacugauugugugggcagccucagcugagacccagaacuuaaaugccggauggacagacacugcacacggcagcgguaucauuccuaugaaagccgaucuggagcuugacuucucuuugccauccagugcuagcuauaccuacagaaggcagcuccagaacccggccaaugaacaagagaagauccccuuucaucugcagauaucuaaacaggucauccacgcagaaauucaacaccuagggcauuggauggaugcgacauucaaccugaagacugcuuuucacugcuauggcuccugugagaaauacgccuacccuuggcagaccgcaggaugcuucguugaaaaggacuaugaguacgagacgggcuggggguguaauccacccgauugcccuggaguggguacaggcugcaccgccugugggguguaucucgacaagcugaaaucaguaggaaaggucuucaaaaucgugagucuucgguacacucgaaagguuugcauucaguugggcacagaacagaccuguaaaacuguggauagcaacgacugccugaucaccacaucggucaagguguguuuaauagguacgauuuccaaauuucaaccaucugauacccuccuguuccuugggccccugcagcagggcggauugaucuuuaagcaguggugcacuacaaccugucaauucggcgacccgggggacauuaugagcacaccuacuggaaugaagugcccagagcucaauggcucauuucgcaaaaagugugcuuucgccaccacgcccguuugccaguuugaugguaacacaaucaguggguauaaaagaaugauagcaaccaaggacuccuuccagucuuuuaaugugacugaaccucauaucagcaccuccgcucuggaguggauugaucccgacucaagccuaagggaucacaucaacguaauugucagucgggaccugucuuuccaggaucucuccgaaacaccaugucaaaucgaccugacugccagcgcgauagauggagccuggggcucgggugugggcuuuaaucuugugugcaccauuucauugacagagugcucuacguuccugaccaguaucaaggcuugugacgcagccaugugcuacggguccacuacaaccaacuuaguccgcggacagaauacuauccacguugugggcaaagggggacauagcggcucuaaguuuauguguugccacgauacaaaauguagcuccaccggucucguagcugccgcaccucaucugaacagagugacgggguucaaccaggcggacucagauaagauuuucgacgacggagcccccgagugcggcgucaguuguugguuuaaaaagagcggugaaugggugcuuggcguucugaaugggaacuggaugguggucgcugugcuaaucgcccuccugauuuugucuauauuccuguuugcauuaugcuguccaaggcguccguccuauaaaaaggagcacaagccuuga

SEQ ID NO: 10161 - RNA, 3447 nt, Artificial Sequence
  derived and/or modified CDS sequence (opt3) from PUUV(PUUV/Konnevesi/Mg_M114B/2005)__JQ319175.1__GP
augggcaagagcucccccgugugccuguaccucauccuucaggggcuguuguuauucggagccgucaacgcuagaaaucugaacgagcuaaaaauggaauguccucacaccauuggucucggccaagggcugguugugggaucuguagagcuuccaccggugcccauacagcaggucgaaucacugaaguuggagaguagcugcaauuuugaccuccauacauccacugcaggccagcaaucuuucacgaaauggaccugggaaaucaagaacgaucuggccgagaauacacaggcgucgucaacuagcuuucagaccaaaaguuccgaggugaaccugaggggucucuguuuaauuccuacacugguuguggaaaccgcugcccggaugcgcaagacuaucgcaugcuaugaccuuucuuguaaucagacagucugccaaccaaccguguacuugauggggcccauucagacgugucugacuaccaagagcugccuacucggacugggcgaucagcgaauccagguaaacuaugagcguacauacuguguuuccggccaacuuguggaaggggucugcuucaauccuauacacacuauggcccugucacagccaagucauaccuaugacaucgugacaauuauggugagauguuuucuggucaucaaaaagguuaccagcggagauaacaugaaaauugagaagaauuucgagacgcucgugcagaaaacugguugcacagcuaacucuuuucaaggcuacuauaucugccugguaggguccucaagcgaacccuuauacgugccuacccuggacgauuacaggagugcagagguccucucucggauggccuucgcuccacacggagaagaccaugauauagagaagaaugccauuuccgcgcuucgcaucgcaggcaaggugacugguaaagccccgagcacagaaucgucugacaccguucaggggauugcuuuuuccggaucaccccuguauacgaguaccggcguguugacagccaaggaugacccugucuacaucugggcaccaggcaucauuauggaggggaaccacagcgugugugagaaaaagacucuaccccugaccuggacaggauucauaccucucccaggugaaaucgagaaaacuacccagugcacaguauuuuguacccuggcuggccccggggccgauugcgaagcguauuccgagacuggaauuuucaauaucucuagcccgacgugucuuauaaacagaguucagagguuucggggcgccgaacaacagauuaaguucgugugccagcgcgucgacauggacaucacaguguacuguaacggugucaaaaaggugauccugaccaagacuuugguuauugggcagugcaucuauaccuucacaucaauuuuuagucucauaccuggcaucgcacacucccuggcuguggaguuauguguacccggacugcauggcugggccaccguccuacuccugcuuacuuucugcuuuggguggguguugauuccaacaaucacgaugauccugcucaaaauucugauagcuuucgccuaccuuuguagcaaguauaauaccgauucuaaauuuaagauccugguugagaaagugaagaaggaauaccagaaaacuaugggaucaauggucugcgaggugugccaauacgaaugugagacagcaaaggaauuggagagucaccgaaaaagcugcuccauugguucuuguccuuauugccucaaccccucggaggccaccccaagcgcucugcaggcgcauuucaagguauguaaauuaacauccagauuucaggaaaaucugaagaagucacuaacuauguacgagcccaugcaaggcugcuauaggacccucagucuguuccgguaccguucucgcuuuuucguggggcuuguuugguguauguugcugguccucgaacugaucgugugggcagccagcgcugagacgcagaacuuaaaugccggauggaccgacacagcacacggcuccgguauuaucccuaugaaagccgaucuggagcuugacuuuucauugccaagcucugcuuccuauacuuacagaaggcagcuccagaacccggccaaugaacaagagaagauacccuuccacuugcagaucaguaaacaggugauucaugcagaaauccaacaccuagggcauuggauggaugcgaccuuuaaccugaagacagcuuuccacugcuauggcagcugugagaaauacgccuacccuuggcagacugcaggaugcuucgucgaaaaggacuaugaguacgagaccggcuggggguguaauccacccgauugcccuggaguugguacgggcugcacagccugugggguguaucucgacaagcugaaaucugugggaaagguauuuaaaauugucucccuucgguacacccgaaaggugugcauccaguugggcacugaacagacauguaaaaccguugauucaaacgacugccugauaacuaccagugugaaggucuguuuaauugguacaaucagcaaauuccaaccaucggauacgcuccuguuucuugggccccugcagcagggcggauugauuuucaagcaguggugcaccacuacaugucaauuuggcgacccgggggacaucauguccaccccuacaggaaugaagugcccagagcucaauggcucuuuccgcaaaaagugugcuuuugccacuacccccgugugccaguucgaugguaacacgauaagcggguauaaaagaaugaucgcaacaaaggacucauuucagaguuucaauguuaccgaaccucauauuuccacuucugcucuggaguggaucgaucccgacagcucccuaagggaucacauuaacgugaucguaucacgggaccugagcuuucaggaucucagugaaaccccaugucaaauagaccugauugccucugcgaucgauggagccuggggcuccggugucggcuucaaucuugugugcacagugagcuugacugagugcucgaccuuucugacaucaaucaaggcuugugacgcagccaugugcuacgggucuacgaccauuaacuuaauccgcggacagaacacuauucacgucguuggcaaagggggacauaguggcuccaaguucauguguugccacgauacaaaauguagcucuaccggucucguggcugccgcaccucaucuggacagaguaacuggguucaaucaggcggauagcgacaagauauuugacgauggagcccccgagugcggcguguccuguugguucaaaaagucaggugaauggguccuuggcgugcugaacgggaauuggaugguuguggcuguccuaaucgcccuccugauuuugaguaucuuucuguucgcauuaugcuguccaaggcguccgagcuauaaaaaggagcacaagccuuga

SEQ ID NO: 10162 - RNA, 3447 nt, Artificial Sequence
  derived and/or modified CDS sequence (opt3) from PUUV(PUUV/Konnevesi/Mg_M78B/2005)__JQ319174.1__GP
augggcaagagcucccccgugugccuguaccucauccuucaggggcuguuguuauucggagccgucaacgcuagaaaucugaacgagcuaaaaauggaauguccucacaccauuggucucggccaagggcugguugugggaucuguagagcuuccaccggugcccauacagcaggucgaaucacugaaguuggagaguagcugcaauuuugaccuccauacauccacugcaggccagcaaucuuucacgaaauggaccugggaaaucaagaacgaucuggccgagaauacacaggcgucgucaacuagcuuucagaccaaaaguuccgaggugaaccugaggggucucuguuuaauuccuacacugguuguggaaaccgcugcccggaugcgcaagacuaucgcaugcuaugaccuuucuuguaaucagacagucugccaaccaaccguguacuugauggggcccauucagacgugucugacuaccaagagcugccuacucggacugggcgaucagcgaauccagguaaacuaugagcguacauacuguguuuccggccaacuuguggaaggggucugcuucaauccuauacacacuauggcccugucacagccaagucauaccuaugacaucgugacaauuauggugagauguuuucuggucaucaaaaagguuaccagcggagauaacaugaaaauugagaagaauuucgagacgcucgugcagaaaacugguugcacagcuaacggcuuucaaggguacuauaucugccugguaggaucuuccucagaacccuuauacgugccuacccuggacgauuacaggagcgcagagguccucagucggauggccuucgcuccacacggcgaagaccaugauauagagaagaaugccauuucugcgcuucgcaucgcagguaaggugacugggaaagccccguccacagaaagcucggacaccguucagggaauugcuuuuucuggcucccccuuguauacgucaaccggcguguugacagccaaggaugacccugucuacaucugggcaccagggaucauuauggagggaaaccacagugugugugagaaaaagacucuaccccugaccuggacagguuucauaccucucccaggcgaaaucgagaaaacuacccagugcacaguauuuuguacccuggcugggcccggagccgauugcgaagcguauagcgagacuggcauuuucaauaucuccucuccgacgugucuuauaaacagaguucagagguuucggggugccaagcaacagauuaaauucgugugccagcgcgucgacauggacaucacaguguacuguaacggggucaagaaggugauccugaccaaaacuuugguuauuggccagugcaucuauaccuucacaagcauuuuuagccucauaccuggaaucgcacacagucuggcuguggaauuauguguacccggccugcaugggugggccaccguccuacuccugcuuacuuucugcuuuggauggguguugauuccaacaaucacgaugauccugcucaagauucugauagcuuucgccuaccuuuguuccaaauauaauaccgauagcaaguuuaaaauccugguugagaaggugaagaaagaguaccaaaagacuauggguucuauggucugcgaagugugccaguacgagugugaaacagcaaaagaguuggaaucacaccgaaagaguugcagcauuggcuccuguccuuauugccucaaccccucugaggccaccccaucggcucugcaggcgcauuucaaaguauguaaguuaacaagcagauuucaggagaaucugaagaaaucccuaacuauguacgaacccaugcaagggugcuauaggacccucucacuguuccgguaccguagucgcuuuuucgugggacuuguuugguguauguugcugguccucgagcugaucgugugggcagccucugcugaaacgcagaacuuaaaugccggcuggaccgacacagcacacgguagcgggauuaucccuaugaaggccgaucuggagcuugacuuuuccuugccaucaagcgcuucuuauacuuacagaaggcagcuccagaacccggccaaugagcaagaaaagauacccuuccaucugcagaucuccaaacaggugauucacgcagagauccaacaccuaggccauuggauggaugcgaccuuuaaccugaaaacagcuuuccacugcuauggaaguugugaaaaguacgccuacccuuggcagacugcaggcugcuucgucgagaaggacuaugaauacgagaccggguggggauguaauccacccgauugcccugguguuggcacggggugcacagccuguggaguguaucucgacaaacugaagucagugggcaaaguauuuaagauugucucucuucgguacacccgaaaagugugcauccaguuggguacugagcagacauguaagaccguugauuccaacgacugccugauaacuaccucagugaaagucuguuuaauugggacaaucaguaaguuccaaccaagcgauacgcuccuguuucuuggcccccugcagcagggaggcuugauuuucaagcaguggugcaccacuacaugucaauuuggggacccgggagacaucaugucgaccccuacaggcaugaaaugcccagaacucaaugguuccuuccgcaagaaaugugcuuuugccacuacccccgugugccaguucgaugggaacacgauaucuggauauaagagaaugaucgcaacaaaagacagcuuucagucauucaauguuaccgagccucauauuaguacuuccgcucuggaauggaucgaucccgacucuagccuaagggaucacauuaacgugaucguaucccgggaccugucauuucaggaucucagcgagaccccaugucaaauagacaugacagccagugcgauugauggcgccugggguucuggcgucggguucaaucuggugugcacugugucccuuaccgaaugcagcacauuuuugacgucgaucaaggcuugugacgcagccaugugcuacggaucaaccacuacaaaccugguccgcggccagaacaccauccacguuguggggaagggaggccauucugguaguaaauucauguguugccacgauacuaaguguuccagcaaaggguuaguagcugccgcaccucaucucgacagagugacaggauucaaucaggcggauucugacaagauuuuugacgauggcgcccccgagugcggugucagcuguugguucaaaaaguccggcgagugggugcuggggguucuuaacggaaauuggaugguggucgcugugcugaucgcccuacucauucugucaauauuuuuguucgcacugugcuguccaaggcguccgaguuauaagaaagaacacaagccuuga

SEQ ID NO: 10163 - RNA, 3447 nt, Artificial Sequence
  derived and/or modified CDS sequence (opt3) from PUUV(PUUV/Konnevesi/Mg_O78A/2005)__JQ319172.1__GP
augggcaagagcucccccgugugccuguaccucauccuucaggggcuguuguuauucggagccgucaacgcuagaaaucugaacgagcuaaaaauggaauguccucacaccauuggucucggccaagggcugguugugggaucuguagagcuuccaccggugcccauacagcaggucgaaucacugaaguuggagaguagcugcaauuuugaccuccauacauccacugcaggccagcaaucuuucacgaaauggaccugggaaaucaagucggaucuggccgagaacacacaggcgucaagcaccaguuuucagacuaaauccucugaggugaaucugaggggucucuguuuaauuccuacacugguuguggaaaccgcugcccggaugcgcaagacuaucgcaugcuaugaccuuagcuguaaccagacagucugccaaccaaccguguacuugauggggcccauucagacgugucugacuaccaaguccugccuacucggacugggcgaucagcgaauccagguaaauuaugagcguacauacuguguuucaggccaacuuguggaaggggucugcuucaacccuauacacacuauggcccugagucagccaagccauaccuaugacaucgugacaauuauggugagauguuuucuggucaucaaaaagguuaccucuggagauuccaugaaaauugagaagaauuucgagacgcucgugcagaaaacugguugcacagcuaacucauuucaaggcuacuauaucugccugguagggagcaguucugaacccuuauacgugccuacccuggacgauuacagguccgcagagguccucagccggauggccuucgcuccacacggagaagaccaugauauagagaagaaugccauuucggcgcuucgcaucgcaggcaaggugacugguaaagccccgucuacagaauccucagacaccguucaggggauugcuuuuaguggaagcccccuguauacguccaccggcguguugacagccaaggaugacccugucuacaucugggcaccaggcaucauuauggaggggaaccacucugugugugagaaaaagacucuaccccugaccuggacaggauucauaccucucccaggugaaaucgagaaaacuacccagugcacaguauuuuguacccuggcuggccccggggccgauugcgaagcguauagcgagacuggaauuuucaauaucucaaguccgacgugucuuauaaacagaguucagagguuucggggcgccgaacaacagauuaaguucgugugccagcgcgucgacauggacaucacaguguacuguaauggugucaaaaaggugauccugaccaagacuuugguuauugggcagugcaucuauaccuucacauccauuuuuagccucauaccuggcaucgcacacucucuggcuguggaguuauguguacccggacugcauggcugggccaccguccuacuccugcuuacuuucugcuuuggguggguguugauuccaacaaucacgaugauccugcucaaaauucugauagcuuucgccuaccuuuguucaaaguauaacaccgauaguaaauuuaagauccugguugagaaagugaagaaggaauaccagaaaacuaugggaagcauggucugcgaggugugccaauacgaaugugagacagcaaaggaauuggagucccaccgaaaaucuugcucgauugguagcuguccuuauugccucaaccccuccgaggccaccccaucagcucugcaggcgcauuucaagguauguaaauuaacaaguagauuucaggaaaaucugaagaagucucuaacuauguacgagcccaugcaaggcugcuauaggacccucagccuguuccgguaccguucccgcuuuuucguggggcuuguuugguguauguugcugguccucgaacugaucgugugggcagccucagcugagacgcagaacuuaaaugccggauggaccgacacagcacacggcagcgguauuaucccuaugaaagccgaucuggagcuugacuuuucuuugccauccagugcuagcuauacuuacagaaggcagcuccagaacccggccaaugaacaagagaagauacccuuccacuugcagaucucuaaacaggugauucaugcagaaauccaacaccuagggcauuggauggaugcgaccuuuaaccugaagacagcuuuccacugcuauggcuccugugagaaauacgccuacccuuggcagacugcaggaugcuucgucgaaaaggacuaugaguacgagaccggcuggggguguaauccacccgauugcccuggaguugguacgggcugcacagccugugggguguaucucgacaagcugaaaucagugggaaagguauuuaaaauugucagucuucgguacacccgaaaggugugcauccaguugggcacugaacagacauguaaaaccguugauagcaacgacugccugauaacuaccucggugaaggucuguuuaauugguacaaucuccaaauuccaaccaucugauacgcuccuguuucuugggccccugcagcagggcggauugauuuucaagcaguggugcaccacuacaugucaauuuggcgacccgggggacaucaugagcaccccuacaggaaugaagugcccagagcucaauggcucauuccgcaaaaagugugcuuuugccacuacccccgugugccaguucgaugguaacacgauaaguggguauaaaagaaugaucgcaacaaaggacuccuuucagucuuucaauguuaccgaaccucauauuagcacuuccgcucuggaguggaucgaucccgacucaagccuaagggaucacauuaacgugaucguaagucgggaccugucuuuucaggaucucuccgaaaccccaugucaaauagaccugacagccagcgcgauugauggagccuggggcucgggugucggcuucaaucuugugugcacuaucucauugaccgagugcucuacauuucugacgaguaucaaggcuugugacgcagccaugugcuacggguccaccacuacaaacuuagugcgcggacagaauaccauucacgucguuggcaaagggggacauagcggcucuaaguucauguguugccacgauacuaaauguagcuccacaggucucguggcugccgcaccucaucugaacagaguaaccggguucaaccaggcggacucagauaagaucuuugacgacggagcccccgagugcggcgugaguuguugguucaaaaagagcggugaauggguccuuggcgugcugaaugggaacuggaugguuguggcuguccuaauugcccuccugauauugucuaucuuucuguucgcauuaugcuguccaaggcguccguccuauaaaaaggagcacaagccuuga

SEQ ID NO: 10164 - RNA, 3447 nt, Artificial Sequence
  derived and/or modified CDS sequence (opt3) from PUUV(PUUV/Pieksamaki/human_kidney/2008)__JN831951.1__GP
augggcaagagcucccccgugugccuguaccucauccuucaggggcuguuguuauucggagccgucaacgcuagaaaucugaacgagcuaaaaauggaauguccucacaccauuggucucggccaagggcugguugugggaucuguagagcuuccaccggugcccauacagcaggucgaaucacugaaguuggagaguagcugcaauuuugaccuccauacauccacugcaggccagcaaucuuucacgaaauggaccugggaaaucaagucggaucuggccgagaacacacaggcgucaagcaccaguuuucagacuaaauccucugaggugaaucugaggggucucuguuuaauuccuacacugguuguggaaaccgcugcccggaugcgcaagacuaucgcaugcuaugaccuuagcuguaaccagacagucugccaaccaaccguguacuugauggggcccauucagacgugucugacuaccaaguccugccuacucggacugggcgaucagcgaauccagguaaauuaugagcguacauacuguguuucaggccaacuuguggaaggggucugcuucaacccuauacacacuauggcccugagucagccaagccauaccuaugacguggugacaaucauggucagauguuuucugguuauuaaaaaggugaccucuggagauuccaugaaaaucgagaagaauuucgagacgcucguacagaaaacugguugcacagcuaacaauuuucaaggcuacuauauuugccugguggggucaagcagugaacccuuauacgucccuacccuggacgauuacaggucugcagaggugcucucccggauggccuucgcuccacacggagaagaccaugauaucgagaagaacgccauaagcgcgcuucgcauugcaggcaagguuacugguaaagccccgucgacagaaucuuccgacaccgugcaggggaucgcuuuuucaggaaguccccuguauacgagcaccggcgucuugacagccaaggaugacccuguguacauuugggcaccaggcaucaucauggaggggaaucacuccguaugugagaaaaagacucuaccccugaccuggacaggauucauuccucucccaggugaaauagagaaaacuacccagugcacaguguuuuguacccuggcuggccccggggccgauugcgaagcguauucugagacuggaaucuucaacauuagcucaccgacgugucuuaucaauagaguucagagguuucggggcgccgaacaacagauaaaguucgucugccagcgcguggacauggacauuacagucuacuguaacggugugaaaaagguuauccugaccaagacuuuggugaucgggcagugcauuuauaccuucacaaguaucuuuucccucauuccuggcauagcacacagccuggcuguagaguuauguguccccggacugcauggcugggccaccgugcuacuccugcuuacuuucugcuuuggguggguuuugaucccaacaauuacgaugauccugcucaaaauccugauugcuuucgccuaccuuuguucuaaguauaacaccgauucaaaauuuaagauacugguggagaaagucaagaaggaauaccagaaaacuaugggaaguauggugugcgagguaugccaauacgaaugugagacagcaaaggaauuggagagccaccgaaaauccugcucuaucgguucguguccuuauugccucaaucccagcgaggccaccccauccgcucugcaggcgcauuucaagguguguaaauuaacaucaagauuucaggaaaaccugaagaagagucuaacuauguacgagcccaugcaaggcugcuauaggacccucucucuguuccgguaccguagccgcuuuuucguugggcuugucugguguauguugcuggugcucgaacugauugugugggcagccuccgcugagacgcagaauuuaaacgccggauggaccgacacagcacacggcucagguaucauuccuaugaaagccgaucuggagcuugacuuuagcuugccaucuuccgcuaguuauacuuacagaaggcagcuccagaauccggccaacgaacaagagaagauccccuuccacuugcagauaagcaaacaggucauccaugcagaaauucaacaccuagggcauuggauggaugcgaccuuuaaucugaagacagcuuuccacugcuauggcucuugugagaaauacgccuacccuuggcagacugcaggaugcuucguugaaaaggacuaugaguacgagaccggcuggggguguaacccacccgauugcccuggaguggguacgggcugcacagccugugggguguaucucgacaagcugaaauccguaggaaaggucuuuaaaaucgugucacuucgguacacccgaaagguuugcauucaguugggcacugaacagacauguaaaaccguggauaguaaugacugccugaucacuaccagcgucaagguguguuuaauagguacaauuucgaaauuccaaccauccgauacgcuccuguuucuugggccccugcagcagggcggauugaucuucaagcaguggugcaccacuacaugucaauuuggcgacccgggggacauuaugucuaccccuacaggaaugaagugcccagagcucaacggcagcuuccgcaaaaagugugcuuuugccacuacccccguuugccaguucgaugguaauacgaucucaggguauaaaagaaugauagcaacaaaggacaguuuucaguccuucaacgugaccgaaccucauaucucuacuagcgcucuggaguggauugaucccgacuccucacuaagggaucacaucaauguaauugucagccgggaccugaguuuucaggaucucucugaaaccccaugucaaaucgaccugacagccuccgcgauagauggagccuggggcagcggugugggcuucaaccuugugugcacuauuucguugaccgagugcucaacauuucugacgucuaucaaggcuugugacgcagccaugugcuacgggaguaccacuacaaauuuaguccgcggacagaacaccauccacguugugggcaaagggggacauuccggcagcaaguucauguguugccacgauacuaaauguucuagcacaggucucguagcugccgcaccucaucuggacagagugaccggguucaaccaggcggauuccgacaagauuuuugacgauggagcccccgagugcggcgucucauguugguucaggaaaaguggugaaugggugcuuggcguucugaaugggaacuggaugguggucgcugugcuaaucgcccuccugauuuugagcauauuucuguucgcauuaugcuguccacgucggccgucuuauaagaaagagcacaagccuuga

SEQ ID NO: 10165 - RNA, 3447 nt, Artificial Sequence
  derived and/or modified CDS sequence (opt3) from PUUV(Samara_49/CG/2005)__AB433850.2__GP
augggcaagcugagccccgugugccucuaccuucuguugcagggguuacugcuauguaaaaccggaacagccagaaaccucaaugagcugaagauggaaugcccucacacuaucggucuuggccaagggcuggucguuggauccguggaguugccaccgguacccauucaacagguggaaacgcucaaacuggagucuucauguaacuucgaccugcauaccaguacagcuggccagcaagcauuuacuaaguggaccugggaaauaaaaggugaucucgccgagaauacacaggcgagcuccaccucuuuccagacuaagucgucagaggucaacuuaagggggcugugccuuaucccuacauuggugauugaaaccgcugcccggaugcgcaagacgaucgcauguuaugaccugagcugcaaucagacuguuugucaaccaaccguguaccuaaugggacccauucagacaugcaucacuaccaaaaguugucuccugggccuuggcgaucagcgaauacaggucaacuaugagaagacauacugcguguccgggcaacugguagaaggaguuuguuuuaauccuauccacaccauggccuugucucagccaagccauacguaugacauugugacuaugaugguccguugcuuccucgugaucaaaaaggugacauccggugauucaaugaaaauugagaagaacuuugagacccugguccagaagaauggcugcacugcuaacaguuuccaaggguacuauaucuguuuaauaggaucuagcuccgaaccccuguacguuccuacacucgacgauuacagaucagcagaggugcuuagcaggauggccuuugcuccacacggcgaagaccaugauguagagaaaaaugccauuagugcgcugcggaucgcagguaaggugaccgggaaagccccgucuacggaauccagcgacaccguccagggaauugcuuucucgggcucucccuuguauacauccacuggcgugcuaaccgccaaggaugacccuguuuacaucugggcaccagggaucauuauggagggaaaccacucagugugcgagaaaaagacacugccccucacuuggaccgguuuuauaagucugccuggcgaaaucgagaaaacaacccaguguacugucuucugcacgcuugcugggccaggagccgauugugaagcguauagcgagacaggcauuuuuaauaucuccucuccgaccugccugauaaaccgcgugcagagauucaggggugccgaacaacagauuaaguuuguaugucagcggguugacauggacaucacuguguacugcaauggggucaagaaagugaucuugaccaagacacucgucauuggccaguguaucuauaccuucacuagcauuuucucacugauacccggaguggcacacaguuuagcuguugagcugugcgugccuggccuacaugggugggccacaaugcuccugcuuuugacguuuuguuucggauggguacugauccccaccauuacuaugauccuccugaaaauccuuauugcuuuugccuaccugugcuccaaguauaacacagauagcaaauuccgcauauugaucgagaaggucaagcgagaauaccagaaaaccauggguucuauggugugcgagguuugucaguacgaaugcgagacagcaaaggaacucgagucacacaaaaagaguuguagcauuggcuccugcccauauugucugaacccuucugaggccacuaccucggcuuuacaggcgcauuuuaaagugugcaagcugacgagcagauuccaggaaaaucuaaggaagucccucaccgucuacgagcccaugcaaggguguuaucggacacugucacuuuuucguuaccgcaguagauucuuugugggauugguauggugcgugcugcucguucuggaauuaaucgucugggcagccucugcugagacucagaaccugaaugccggcuggaccgacacagcacacgguagcgggauuaucccaaugaaaacugaucuugaguuggacuucucccuccccucaagcgccucuuauaccuacaggcggcagcugcagaacccugcuaaugaacaagagaacauaccauuucaccuacagaucuccaaacaggugauucaugccgaaauccaacaccugggccauuggauggaugcaacguucaaucucaagacagcguuucacuguuauggaaguugcgagaaguacgcuuacccguggcagaccgccggcuguuucguggaaaaagacuaugaguacgagacuggguggggaugcaaucccccugauugcccaggugucggcacaggguguaccgcaugcggagccuaucuggacaaacuuaagagcguuggcaagguguucaagauugugucuuugcgauacacucgcaaaguauguauccagcuggguaccgaacagacaugcaagacggucgauuccaacgacuguuuaauaaccacuucagugaaaguuugccucauugggacaaucaguaaguuucaacccagcgauacccugcuuuuccugggcccuuugcagcagggaggccucauuuuuaaacagugguguacaacuaccugccaauucggggacccaggagacaucaugucgacgcccacaggcaugaaguguccggaucugaacgguuccuuuagaaagaaaugcgcuuucgccaccacuccugugugucaguuugacgggaauaccauaucuggauauaagaggaugaucgcaacaaaagauagcuuccagucauuuaacgucacugagccacauauuagugcuuccgcccuagaauggaucgaccccgauucuagccugcgggaccacauuaaugugaucguuucccgcgaucucucauuccaggaccugagcgagaccccuugccaaauagaucuuaguacagcgucuauugacggcgccugggguuccggcgugggguuuaacuugguaugcacggucagccugaccgaauguucggcuuucuuaacuucaaucaaggcaugcgaugccgcuauguguuacggaucuacaaccgccaaucucaucagaggccagaacacuauucacaucguggggaaaggaggccauagugguuccaaguuuaugugcugucacgacacaaagugcagcaccacggggcugguggcagcggcuccccaucuugauagggucacuggauauaaccaggccgacucugacaaaauuuucgaugacggcgccccagagugugguaugagcugcugguucaagaaauccggcgaguggauacuggggguucuaaauggaaacuggauggugguagcagugcucaucgcucuguugguccugucaauuuuacucuuuacccuguguugcccucgucggcccaguuaccgaaaggaacacaaaccauga

SEQ ID NO: 10166 - RNA, 3447 nt, Artificial Sequence
  derived and/or modified CDS sequence (opt3) from PUUV(Samara_94/CG/2005)__AB433852.2__GP
augggcaagcugagccccgugugccucuaccuucuguugcagggguuacugcuauguaacaccggaacagccagaaaucucaacgagcugaaaaucgaaugcccucacacuauuggucuuggccaagggcuggucguuggauccguggaguugccaccgguacccauacaacagguggaaacgcucaagcuggagucuucauguaauuucgaccugcauaccaguacagcuggccagcaagcauuuacuaaauggaccugggaaaucaagggugaucucgccgagaacacacaggcgagcuccaccucuuuccagacuaaaucgucagaggucaauuuaagggggcugugccuuauuccuacauuggugaucgaaaccgcugcccggaugcgcaagacgauugcauguuaugaccugagcugcaaccagacuguuugucaaccaaccguguaccuaaugggacccauccagacaugcauaacuaccaagaguugucuccugggccuuggcgaucagcgaauccaggucaauuaugagaaaacauacugcguguccgggcaacugguagaaggaguuuguuuuaacccuauucacaccauggccuugucucagccaagccauacguaugacaucgugacuaugaugguccguugcuuccucauuaucaagaaagugacauccggugauucaaugaagauagagaaaaauuuugagacccuggugcagaagaacgacugcacugcuaauaguuuccaaggcuacuauauuuguuuuaucgggucaucuuccgaacccuuauacgucccuacacuggaugacuacagaucagcagagguucucagcaggauggccuucgcuccacacggagaagaucaugacguggagaagaacgccauuagugcgcuucggaucgcaggcaaaguaaccgguaaggccccgucuacggaauccagcgauaccgugcaggggaucgcuuuuucgggaucuccccuguauacauccacuggcgucuuggccgcaaaagacgauccuguguacauuugggcuccaggcauaaucauggaggggaaucacucaauuugcgagaagaaaacccuaccccugacauggacuggauucaucagucucccuggugaaauagagaagaccacacaguguaccguguuuugcacucuggccggcccaggggcggacugugaagccuauagcgagacgggaauuuucaacaucuccucucccacaugccuuaucaaucgcguucagagauuuaggggcgcagaacaacagauuaaauucgucugucagcggguggacauggauaucaccguauacugcaacgguguuaagaaggugauucugacuaaaaccuuggucauagggcaguguaucuauacauucaccagcauuuuuagccucaucccgggcguggcucacagucuggccgucgaguuaugcgugccuggacugcauggcugggcuacuaugcuacuccugcuuacauucuguuuuggguggguuuugauccccacgauuaccaugauacugcucaagauccugauugccuucgcauaccuuugcuccaaauauaacacugacagcaaguuucgcauccugauugagaaagugaagaaggaauaccagaaaacaaugggaucuaugguaugcgaggucugucaguacgaaugcgagaccgccaaggaauuggagucacaccgaaaaaguuguagcaucgguuccugcccauauugucucaauccuucugaggcuacaacuucggcgcugcaggcacauuucaaggugugcaaauuaaccagcagauuucaggaaaaccugaggaagucccuaacgguuuacgagcccaugcaaggcuguuaucggacccucucacuguuccguuaccgcaguagauuuuucguggggcuugucuggugcguguugcugguacucgaacugauagugugggccgcuucugccgagacacagaauuuaaacgcaggauggacugauaccgcccacggcagcgguaucauuccaaugaagacagaccuggagcuugauuuuuccuugcccucaagcgcuucuuauacuuacaggcggcagcuccagaauccugccaacgaacaagagaauaucccauuccaucugcagauuuccaaacagguuauccacgcagaaauacaacaccuagggcauuggauggacgcgaccuuuaaccugaagacggcuuuccacuguuauggcaguugcgagaaauacgccuacccguggcagacagcaggauguuucgucgaaaaggauuaugaguacgagaccggcugggggugcaaucccccugacugcccaggaguggguacuggcuguacagccugcggggcuuaucucgauaaacuuaagagcgugggaaaggucuuuaaaauuguuucucugcgauacacccgcaagguguguauccaguugggcacugaacagaccugcaaaacaguggacuccaacgauugucugauuacgaccucaguaaaggucugcuuaaucgguacuauaaguaaauuccaacccagcgacacacuccuguuucuugggccucugcagcagggcggauugaucuucaagcagugguguaccacaacuugccaauuuggcgacccaggggauauuaugucgacccccacgggaaugaaauguccggaccucaauggcuccuucagaaagaagugcgccuuugcaacaaccccugugugucaguucgaugguaacacuaucucuggguauaaaaggaugauugcuaccaaggacagcuuucagucauucaauguuacagagccacauaucagugccuccgcgcuggaauggauagaucccgacucuagccuacgggaucacauuaacgugaucgucucccgcgaccugucauuucaggaucucagcgagacuccuugccaaaucgaccugaguaccacaucuauugauggagccuggggcuccggugugggcuucaaucuuguuugcacggugagcuugaccgaauguucggcuuuucugacuucaaucaaagcaugcgacgccgcuauguguuacgggucuacaaccgccaacuuaauuagaggacagaacacuauacacaucguaggcaaagggggacauaguggcuccaaguucaugugcugucacgauacaaagugcagcaccacgggucucgucgcagcggcuccccaucuggacagggugacuggguauaaucaggccgacucugauaagauuuucgacgauggagccccagaguguggcaugagcugcugguuuaaaaaguccggugaguggauccuuggcgugcugaacgggaauuggauggucguugcagugcuaauugcucuccugguauugucaauccuguuauucacccucuguugcccucgucggcccaguuaccgaaaagaacacaagccauga

SEQ ID NO: 10167 - RNA, 3447 nt, Artificial Sequence
  derived and/or modified CDS sequence (opt3) from PUUV(Sotkamo)__NC_005223.1__GP
augggcaagagcucccccgugugccuguaccucauccuucaggggcuguuguuauucgacaccgucaacgccaaaaaucugaacgagcuaaagauggaauguccucacacaauuggacucggucaaggccugguuguggggucuguagagcuuccaccggugcccauacagcagaucgaaucacugaaauuggagaguagcugcaauuuugaucuccauacuuccacggcuggacagcaaucuuucaccaaguggacaugggaaacuaaaggcgaccuggcagagaacacccaggccucgucaaccagcuuucagacaaagaguuccgaggucaaucugagaggucucuguuuaauuccuacucuggugguugaaacagcggcuaggaugcggaagaccaucgccugcuaugaucuuucuuguaaccagacggugugccaaccaacugucuacuugauggggcccauucagaccugucugacaacuaaaagcugccuacucggacugggcgaccagcgcauccaggugaauuaugagcgaaccuacuguguauccggccaacuuguugaaggggugugcuucaacccuauacacacaauggcacugucacagccaagucauaccuaugauaucgucacgauuauggugcguuguuuucuugugaucaagaaagucacuagcggagacucuaugaagauugagaaaaauuucgagacacucguucagaagaccgguugcacugccaacggcuuucaaggguacuauaucugccugauaggauccucaagcgaacccuuauacgugccuacacuggaugacuacagaagugcugagguacucucuaggauggcauucgccccacacggcgaagaucaugacauugagaagaaugcuguguccgcccuucggaucgcggguaaagucaccgggaaggcaccgagcacggaaucgucugauaccgugcagggaauugccuuuuccggcucaccccuguauacaaguacuggcguuuugaccgcuaaagacgauccuguguacgucugggccccagggaucaucauggagggaaaccacagcgugugugagaagaaaacacuaccccugacuuggaccgguuucauuccucucccaggcgaaauagagaagacaacccagugcacuguauuuuguacgcuggcagggcccggagcugacugcgaagccuauuccgagacaggcaucuucaauauuucuagcccgaccugucuuaucaaccgcguucagagauuuaggggugcggaacaacagauaaaauucgugugccagcgggucgacauggauauuacuguguacuguaauggggucaagaaggugauccugaccaaaacauugguuaucggccagugcauuuauaccuucacuucaaucuuuaguaugauuccuggaauagcccacucccucgcaguggagcuguguguacccggcuuacaugggugggcuacaguccugcuacuccugacguucugcuuuggaugggugcuuaucccaaccauuacuaugaucuugcugaagauccucauugccuucgcuuaccuguguagcaaauauaacacagacucuaaguuucgcauacuuguugagaaagugaagaaggaauaccagaaaaccauggguucaauggucugcgaggugugccaauacgaaugugagacagccaaggaacuggagagucaccgaaaaagcugcuccaucggcucuuguccuuauugcuugaaccccucggaggcaacuccaagcgcccuccaggcucauuucaagguauguaaacugaccuccagauuucaggaaaauuuaaagaagucacugacgauguacgagcccaugcaagggugcuauaggacccuaagucucuuccgguaccguucucgcuuuuucgugggacugguuugguguaugcuuuugguccuggaacucauugugugggcggcaagcgccgagacacagaaccugaaugauggcuggacugacaccgcucacgguuccgggaucauuccuaugaaagccgauuuagagcuggacuuuucacuuccaagcucugcauccuauacauacagaaggcaguugcagaacccggccaaugaacaagagaagauccccuuccaccuccagauaaguaaacaggugauccaugcugaaauucaacaccugggccauuggauggaugccacuuuuaaccuaaagaccgcauuccacugcuauggaagcugugagaaauacgcguacccuuggcagacggcuggcugcuucgucgaaaaggacuaugaguacgagacaggguggggauguaauccacccgauugcccugguguuggcaccgggugcacugccuguggaguguaucuggacaagcucaaaucugugggcaagguauuuaaaaucgucucccugcgguacacacgaaaggugugcauucagcuugguaccgggcagacuuguaaaaccguugauucaaacgacugcuugaucacaacgagugugaaggucugucugauaggcaccauuagcaaauuccaaccaucggacacuuuacucuuucugggaccccuucagcagggcgggcugaucuucaagcaguggugcacaaccacaugucaauuuggagauccgggcgacauuauguccacuccuaccgguaugaagugcccagaauugaaugggucuuuccgcaaaaagugugcauuugccacgacacccgugugccaguucgauggaaacaccaucagcggcuauaaaagaaugguugcuacuaaggacucauuucagaguuucaaugugaccgagccucauauauccacaucugcccucgaauggaucgaucuggacagcucccuaagggaucacauuaacguaaucgucucacgggaccugagcuuucaggaucucagugagacucccugucaaguggaccugaccacaucugcaacggauggugcuuggggcuccggggugggauucaaucuugucugcaccguuagcuugacugaaugcucggccuuucugacaucaauuaaagcgugucacgccgcuaugugcuacggcucuaccacuacaaacuuagugcgcgggcagaauaccauccauguagugggaaagggcggucacaguggguccaaguucauguguugccaugacacgaaauguagcucuacuggacucgucgcagccgcuccacaccuggauagagugaccggcuucaaccaggccgacagcgacaagauauuugaugacggugcaccugagugcggcauguccuguugguucaaaaaguugggggaguggguucugggagugcuaaacggcaauuggauggucguggcgguucucauugcccuguugauccugucaaucuuuuuauucgcucucugcugucccaggcguccaaguuauaaaaaggaucacaagccguga

SEQ ID NO: 10168 - RNA, 3447 nt, Artificial Sequence
  derived and/or modified CDS sequence (opt3) from PUUV(2009)__HE801634.1__GP
augggcaagagcucccccgugugccuguaccucauccuucaggggcuguuguuauucgacaccgucaacgccagaaaucugaacgagcuaaaaauggaauguccucacacaauuggacucggucaaggccugguuguggggucuguagagcuuccaccggugcccauacagcagaucgaaucacugaaguuggagaguagcugcaauuuugaucuccauacuuccacggcuggacagcaaucuuucaccaaauggacaugggaaacuaagggcgaccuggcagagaacacccaggccucgucaaccagcuuucagacaaaaaguuccgaggucaaucugaggggucucuguuuaauuccuacucuggugguugaaacagcggcucggaugcgcaagaccaucgccugcuaugaucuuucuuguaaccagacggugugccaaccaacugucuacuugauggggcccauucagaccugucugacaacuaagagcugccuacucggacugggcgaccagcgaauccaggugaauuaugagcguaccuacuguguauccggccaacuuguugaaggggugugcuucaacccuauacacacaauggcacugucacagccaagucauaccuaugauaucgucacgauuauggugagauguuuucuggugaucaaaaaggucacuagcggagacucuaugaaaauugagaagaauuucgagacacucguucagaaaaccgguugcacugccaacggcuuucaaggguacuauaucugccugauaggauccucaagcgaacccuuauacgugccuacacuggaugacuacaggagugcugagguacucucucggauggcauucgccccacacggcgaagaucaugacauugagaagaaugcuguguccgcccuucgcaucgcggguaaggucaccgggaaagcaccgagcacggaaucgucugauaccgugcagggaauugccuuuuccggcucaccccuguauacaaguacuggcguuuugaccgcuaaggacgauccuguguacgucugggccccagggaucaucauggagggaaaccacagcgugugugagaaaaagacacuaccccugacuuggaccgguuucauuccucucccaggcgaaauagagaaaacaacccagugcacuguauuuuguacgcuggcagggcccggagcugacugcgaagccuauuccgagacaggcaucuucaauauuucuagcccgaccugucuuaucaacagaguucagagguuucggggugcggaacaacagauaaaguucgugugccagcgcgucgacauggauauuacuguguacuguaauggggucaaaaaggugauccugaccaagacauugguuaucggccagugcauuuauaccuucacuucaaucuuuagucucauuccuggaauagcccacucccuggcaguggaguuauguguacccggccugcaugggugggcuacaguccuacuccugcuuacguucugcuuuggauggguguugaucccaaccauuacuaugauccugcucaaaauccugauugccuucgcuuaccuuuguagcaaguauaacacagacucuaaauuuaagauacugguugagaaagugaagaaggaauaccagaaaaccauggguucaauggucugcgaggugugccaauacgaaugugagacagccaaggaauuggagagucaccgaaaaagcugcuccaucggcucuuguccuuauugccucaaccccucggaggcaacuccaagcgcccugcaggcucauuucaagguauguaaauuaaccuccagauuucaggaaaaucugaagaagucacuaacgauguacgagcccaugcaagggugcuauaggacccucagucuguuccgguaccguucucgcuuuuucgugggacuuguuugguguauguugcugguccucgaacugauugugugggcggcaagcgccgagacacagaacuuaaaugcuggcuggacugauaccgcccacgguuccgggaucauuccuaugaaagcagaccuggagcuugauuuuucauugccaagcucugccuccuauacauacagaaggcagcuccagaacccggcuaaugaacaagagaagauccccuuccacuugcagauaaguaaacaggugauccaugccgaaauucaacaccuaggccauuggauggacgcaacuuuuaaccugaagaccgcguuccacugcuauggaagcugugagaaauacgcuuacccuuggcagacggccggcugcuucgucgaaaaggauuaugaguacgagacaggguggggauguaauccacccgacugcccugguguuggcaccgggugcacugcauguggaguguaucucgauaagcugaaaucugugggcaagguauuuaaaaucgucucccuucgguacacacgaaaggugugcauucaguuggguaccgaacagacuuguaaaaccguugacucaaacgauugccugaucacaacgagugugaaggucuguuuaauagggaccauuagcaaauuccaaccaucggacacucuccuguuucuuggcccccugcagcagggaggcuugaucuucaagcaguggugcacaaccacaugucaauuuggggacccgggagauauuauguccacuccuaccggcaugaagugcccagagcucaaugguucuuuccgcaaaaagugugccuuugcuacgacacccgugugccaguucgacgggaacaccaucagcggauauaaaagaaugguugccacuaaggauucauuucagaguuucaaugugaccgaaccucauauauccacaucugcacuggaguggaucgaccccgauagcucccuaagggaccacauuaacguaaucgucucacgggaucugagcuuucaggaccucagugaaacuccaugucaaguggaucugaccacaucugcuauugacggcgccugggguuccggcgugggguucaaucuugucugcacgguuagcuugaccgagugcucggcguuucugacuucaaucaaagccugugaugcugcaaugugcuacggaucuacaaccacuaacuuagugcgcggccagaauacaauacacguaguggggaagggaggccauagugguuccaaguucauguguugccacgacaccaaauguagcucuacggggcucgucgccgcugccccucaucuggauagagugacuggauucaaccaggcagacagcgacaagauuuuugaugacggcgcgcccgagugcgguauguccuguugguucaaaaaguuaggcgaauggguucugggggugcuaaacggaaauuggauggucguggccguucucaucgcucuguugauccugucaauuuuucuuuucgcccucugcuguccaaggcguccgaguuauaaaaaggagcacaagccuuga

SEQ ID NO: 10169 - RNA, 3447 nt, Artificial Sequence
  derived and/or modified CDS sequence (opt3) from PUUV(Umea/hu)__AY526218.1__GP
augggcaagcugagccccgugugccucuaccuuuuccugcaguguuuguuacugugguccagagggucugccaggaaccuaaaugagcucaaaauggaaugcccucacaccaucggacugggucaaggccuugucauugggucaguugagcugccaccggugcccguacaacagguggaaaguuugaagcucgagagcuccuguaacuuugaccugcauacaucuacugcuacgcagcaaucguucaccaaauggacaugggaaaugaaggaugaccuggcagagaauacucaggccucaagcaccaguuuucagacaaaauccucugaggucaaccuccggggauuaugccugauaccuccacuugugguugaaaccgcgagccgcacucgaaagacaaucgcuuguuucgauauuuccugcaaucagaccgugugucaacccacggucuauuuggugggcccuauccagacuugcauuaccacaaagucaugucugcuaggucucggggaccagcguauccagguaaacuacgagaaaacuuauugcguuaguggacaacugguggaaggcgucuguuuuaauccagugcacaccauggugcuuagccagcccucucauacauacgauauagucaccaugaugguuagaugcuuccuggugguaaagaaagugacguccggcgacucaaugaagaucgagaaaaacuuggagacucucguccagaagacagauugcaaugccaacggguuucaaggauauuacauuugucugguggguagcaguucugaaccuuuauauguuccaacccuggacgauuacagguccgcagaggugcucagccggauggccuucgcuccgcacggcgaagaccaugauaucgagcgcaaugcagucucggcccuuagaauuguggggaagguaacuggaaaagcucccucuacagaagccuccgacaccauccagggcauagcguuuucagguaguccucuguacacgagcaccgggguuuugacagcaaaggauaacccaguguaugucuggucccccggaauuaucauggagggcaaucacucugugugcgagaaaaagacucuaccucugaccuggacaggcuucauuccacuccccggggaaaucggaaaaacuagccaguguaccgucuuuugcacacuggccgguccgggcgcugacugugaggccuacucagaaaccgggaucuucaacauuaguuccccuacuugccuuauaaauagggcacagcgguuucgcggagcugagcaacagaucaaguucgugugucagcgaguugacauggauauuacgguguauugcaacggcaugaaaaagguaauccugacaaagaccuuggucauaggucaguguauuuacacuuucaccagcaucuuuucucucauccccgggauugcccacucacuggcgguggaauuaugcguuccaggccugcauggaugggccacagugcuacuccugcuuaccuucuguuuuggcuggaucuugauuccuuucauagcaaugaucagucugaaaauucucaucgcuuuugccuaucugugcagcaaguacaacacugacuccaaauucaagauccuuauugagaaagucaagaaggaguaucagaaaacaauggggucuauggugugcgaaguaugucaguacgagugcgaaacggcuaaggagcuggaaucgcacagaaaaagcugucccauaggauccugcccauacuguuugaaucccucagaggccaccacuagcgcacuccaggcccauuuuaaggugugcaaacugacaucuaggguucaggauaacuuacggaagagucuggcugcguaugagccuaagcaagguuguuaccguacccuaucccucuuccgcuauagaucaagguuuuucgucggcuuuaucuggugcauucugcuuguguuggaacugaucauuugggcagccagcgcugagacacagaaucucaacucuggguggacugacaccgcccacggauccggcaucauaccaaugcggacggaucuggaauuagacuucagucugccgagcucugcauccuacaccuaucgacgccagcuucagaaucccgccaacgagcacgagaaaaucccuuuucauuugcaaauuucaaaacaggugauccacgcugaaauucagcaucucggucacuggauggaugccacauucaaucugaagacugcauuccauuguuacgggaguugcgagaaguaugcguacccauggcaaaccgcuggcugcuuuuucgaaaaagacuacgaguuugaaagcucguggggauguaaucccccugauugcccaggcgucgggacaggauguacugccugcgguguuuaucuagacaagcugaaguccgugggcaaaguguucaagaucauaucucucagauacaccaggaaagcauguauucagcuggggacggagcagacaugcaagagcguagauucaaacgacugucuugucaccacaagugugaaaguuugcuugaucggaacuguguccaaguuucagcccucugacacccuguuauuccucggcccgcuggagcaaggugggcuuauuuuuaaacagugguguacuaccacaugccaguucggcgauccuggagacaucaugagcacgccaaccggcaugaagugucccgaacugaacggguccuuucggaagaaaugcgccuucgcuacuacaccugucugucaguuugauggaaauaccauaucaggcuauaagcgcaugaucgccacaaaagacagcuuccaaaguuuuaacgugacugauccccacauuucuaccuccgcauuggaguggaucgacccagauagcucgcucagagaccacauuaauguugugguaucaagggaucugucuuuccaggaccuaagugaaacgccuugccaggucgaucugacaaccuccagcaucgacggugcuugggggucuggagugggcuucaaccucgugugcacugucagccugaccgaguguuccacauuucuuacuucaauaaaggccugcgauagugcgauguguuacgguagcaccacaauuaauuugaugcguggccagaacacgguucauaucguggggaaaggaggccacucuggguccaaguucaugugcugucaugacaccaagugcucaaguacuggacugguagccgcugcaccccacuuagaccgggugacaggcuuuaaccaagccgauagcgacaaaaucuucgaugacggugcuccagaaugugggauguccugcugguuuaagaaaucuggagaguggauucucggcguccugaaugguaacuggcuugugguugccgugcuggucgcacuauucauccucucgauuuuucuguucaccuuguguugcccgcgaagaccuauauaugcgaaggagcacaaacccuga

SEQ ID NO: 10170 - RNA, 3447 nt, Artificial Sequence
  derived and/or modified CDS sequence (opt3) from PUUV(P360)__L08755.1__GP
augggcgagcugagccccgugugccucugucuucuguugcagggguuacugcuaugcaacaccggagccgcuagaaaucucaacgaacugaagauggaguguccucacacaaucaggcuuggucaaggccuggucguuggguccguggaauugccaucucucccgauucagcagguagagacucugaaacuggaaucaaguugcaauuucgaccuccauacgagcaccgcaggacagcaauccuuuacaaaguggacuugggagauaaaaggcgauuuagccgagaacacccaggcgucuucgacaucauuccagaccaagagcagugaagugaaucugcggggucuuuguuugauccccacucuggucguggagacagcugcccgcaugcgaaaaaccauugcaugcuacgaccuauccuguaaccagacgguuugccaaccuacuguguaucucauggggccaauccagaccuguauuacaacuaagucuugccugcuuagccugggagaucagcguauccaggucaauuacgaaaagaccuauuguguguccggccaauugguagagggcauaugcuuuaaccccauccacacaauggcccucucacagccuagucauaccuacgacauuaugacgaugaugguuagaugcuuccuggugaucaaaaaggucacuagcggggauucuaugaaaauugagaagaauuuugaaacauuagugcagaaaaacggauguaccgcuaauaacuuccaagguuauuacaucugccugauaggcuccucaagcgagccacucuaugugcccgcacuugacgauuacaggagugccgaaguccugucucggauggcuuuugccccucacggggaggaccaugauauugaaaagaaugcgguuuccgcaaugcgcaucgccggaaaggugacuggcaaagcuccaagcacagagucgucugacaccguacaggguauugccuucuccgggucaccguuguacacgaguaccggagugcuaacaagcaaggaugaccccgucuauaucugggcaccuggcaucauuauggagggcaaccacuccauaugugagaaaaagacucugccacucaccuggacaggguuuaucucucugcccggagaaauugagaaaacuacccagugcacaguguucuguacccuugcugguccuggcgccgauugcgaagcguacagcgaaacugggaucuuuaauauaucaaguccaacgugucugauuaacagaguucagagguuccggggauccgagcaacagaucaaguuugugugccagcgcgucgacauggacaucacaguguauuguaacggcaugaaaaagguaauuuugaccaagacucucguuaucggucagugcauuuacaccuucacaagcauauucucucugauccccgggguggcccacucauuagcagucgagcugugugugccgggccuacauggaugggcuaccaugcuccugcuuuugacuuuuugcuucggcuggguccugauuccuacaaucacgaugauccuccugaaaauucuuauagccuuugcuuaucugugcaguaaguacaauaccgauagcaaauuccgaaucuugauugaaaaggugaaaagagaguaucaaaagacuaugggguccaugguuugugaagugugccaguacgagugugaaacagccaaggagcucgagucucacaggaaaucgugcagcaucggauccugucccuacugccugaacccaucagaagcaaccacaagugccuuacaggcucauuuuaagguauguaaacugacuucucgguuccaggagaaucuacguaagagccucaccgucuaugaaccuaugcaagguugcuaccgcacgcugucccuuuuuagauauaggucacgguucuuugugggcuugguuuggugugugcugcucguccuggaguuaauugugugggcggcaagcgccgagacccagaaccugaaugcuggguggacagacacugcccacggaucuggcaucauacccaugaaaaccgaucuugaauuggacuucucccucccaaguagcgcaucuuacacauaucgacgccagcugcagaaccccgccaaugagcaagaaaagaucccuuuucaccuacagcuguccaagcagguaauucaugcugagauccaacaccucggucauuggauggaugccacuuucaaccugaaaaccgcauuucacugcuacgggucaugugaaaaguaugcguacccauggcagacggcuggcugcuucauugagaaagacuacgaguaugaaacaggauggggcugcaauccgcccgauuguccuggggugggaaccgguugcacugccuguggcguuuaccuugacaaguugaaaagugucgggaagguguucaagaucgugagccugagauauacaaggaaagucugcauacaguuaggaaccgagcagacuuguaagaccguugauucgaacgacugccucauuacaacguccgugaaagugugucugaucggcaccauuucuaaguuucaaccaagcgauacucuucuguucuuggguccccuccagcaagggggccugaucuuuaaacaguggugcacaaccacaugucaguucggagacccuggcgacauaaugucaacuccaaccgggaugaagugccccgaacuaaauggaaguuuucggaaaaagugugcauucgccacgacaccgguaugccaguuugauggcaacaccaucuccgguuacaagcgcaugauugcuacuaaagacucuuuccagagcuuuaaugucaccgagccucauaucuccacaucagcccuggaauggauugauccagacagcagucucagagaucacaucaacgugauaguuucuagggaccuguccuuccaggaucuuagcgagacucccugccaaauugacuuggcaaccgcuucgaucgauggggccuggggaucaggcguggguuuuaaucuggucuguacagugucuuuaacggagugcagugcguuccucaccuccaucaaggccugugacgcugcaaugugcuauggcagcacuacagccaaccugguucgugggcagaacaccauucacaucgugggaaaaggcgggcauucuggaagcaaguuuauguguugccacgauacuaaauguuccucaacaggccuuguagcugccgcaccucaucuggaccgggucaccgguuacaaucaggcggauagugacaagauuuucgacgauggggcccccgaaugcggaaugagcuguugguucaagaaaucuggcgaguggauacuaggugugcucaacggcaauuggaugguggucgcuguucuggugguauugcugaucuuauccauucuccuguuuacgcuuugcuguccacgaagaccuucauauaggaaggaacacaaacccuga

SEQ ID NO: 10171 - RNA, 3447 nt, Artificial Sequence
  derived and/or modified CDS sequence (opt3) from MUV(11-1)__JX028272.1__GP
augggcaagaucagccccguguaccuguaucuccuuuuccaggggcuguuguuauggagagacggacuggccaggaaccuaaaugagcucaaaauggaaugcccucacaccauuggucugggccaagggcuugucauaggauccguugagcugccaccggugcccuugcggcagguagaaucucucaagcuggagucaaguuguaacuuugaucugcauacaagcacugcuacgcagcaguccuucaccaaauggaucugggaaucuaagaaugaccucacagauucgacucaagcaucaagcaccaguuaccagacaaaauccaccgaggugaacuuaaagggccugugccuugucccuacuuuggugauugagacagccgcgcgcacccgaaagacgaucgcuuguuuugaccugucuugcaaucagacuguuugucagccaaccguguaucuaauuggucccauccaaacaugcauaacuaccaaaagcugucucaucgggcugggagaucagcguauucaggucaacuacgaaaagacauauugcguguccggccagcuuguagagggcguuuguuucaauccuauccacaccauggcccugucacaaccaagucauacguacgacguggucacuaugauggugagaugcuuuuugguggucaaaaagguuacaagcggggauucuaugaaaauugaaaagaacuucgagacccucgugcagaagacuggauguuccaauaacaauuuucaggguuauuacguaugccugaucggcucaagcagugagcccuuauacgugccuacacuggacgauuauaggucugcagaaauacucucccggauggccuucgcuccacacggggaggaccaugauauugaacgcaacgcaaucagcgccaugagaauugucggaaaagugaccggcaaggcuccgucgucugaguccucagacacgguucaagguguggccuuuagugggaauccccuuuacaccagcacaggaguccugacuuccaaagaugacccuguguauguaugggcgccaggcaucaucauggaaggcaaccacucuguuugcgacaagaaaaccuugccccuaacauggacuggguacauuccucugccaggagagauagagaagaccacacaguguaccguguucugcacucucgcaggucccggcgccgauugugaggcuuauagcgagacggggaucuuuaauauuucaaguccgacaugccugaucaacaggguccagcgguuccgcggagccgaacagcaaauaaaauuugugugucagcgagucgacauggauauuaccguguacugcaacggcaucaagaagguuauccuuacuaaaacccuggugauuggucaguguaucuauacauucaccuccauuuucagcuugaugccugggguagcacacucucucgcugucgagcugugcgugcccggcuuacauggaugggccacuaugcugcuacuccugacauuuuguuucggcuggauacuuaucccaacgauuaccuugauccugcucaagauccugcuugcguuugccuacguuugcucaaaauacaauacugacaguaaguucaaaauucugauagaaaaggugaagcaggaguaucaaaagacaauggggagcauggucugugaggugugccagcacgaaugcgagaccgcaaaggaauuggagucccauaaaaagucuuguccuaucggaucgugccccuacugucucaacccagcugaagccacaacuagcgcucugcaggcccacuuuaaaguaugcaaguuaaccuccagauuccaggagaaucugaggaagucacuaacgguguaugagcccaaacaagguuguuaccggacccucagucuguuucguuaucgcucuagaugcuucguuggccuuauuugguguaucuugcugacacucgaacugauugucugggcagccagcgcugagacuuuaaaccugaauccuggguggaccgauacagcgcacggauccggcaucgugccaaugaagacugaccuugaauuggauuuuucacucccgagcucugcauccuacaccuauaggcggagucugcagaaccccgccaaugagcaggaacaggugccuuuccaucuacaaauagaaaaacaggucauccacgcugagauucagcaucugggucacuggauggacgccacguuuaaccucaagacagcauuccauugcuacggggccugugaaaaauacgcuuauccauggcaaaccgccggcugcuuuguugagaaggauuucgaguucgaaaauggauggggcuguaaucccccugacugcccaggggugggaacugguugcacagcauguggcgcguaccuggauaaacuuaaaagcguggggaagguauuuaaaaucgucucuuugcgauauacccgcaaggcuugcauucagcugggaacugagcagaccuguaaaaauguggacuccaacgacugcuuaguuacaacgucagugaaggucugucucaucggcaccauaaguaaauuccagcccagcgauacucugcuuuuucuggguccguuggaacaagggggcauuaucuucaagcaguggugcacaaccacaugucaguuuggagacccuggcgauauuaugucgacuccaaucgggaugaagugccccgagcucaauggauccuucagaaagaaguguucuuuugccaccacgccugugugccaguucgacggcaacacaauaagcgguuacaaaaggaugaucgcaaccaaggauucauuucaaaguuucaauguuacugaaccccacauuuccgccucugcucuggaguggaucgacccagauagcucccuacgggaccacauuaacgugguagucgggcgcgaucugccuuuucaggaccucucagaaacccccugucagaucgaucugagcacaaguucuauagacggagccuggggcuccggugugggcuucaaccuugugugcagcgucucguugacugagugcuuuaccuuccugaacucaauuaaagcaugugauacagcuaugugcuaugggucuacgaccgccaacuuaguuagaggacagaauacugugcauguagugggcaaagggggacacaguggcuccaaguucauguguugccaugacacaaaauguagcaacaccggucuccuggcggccgcuccacaccuugacagggucacuggguacaaucaagcagauucugacaagguguuugaugacggagccccggagugcggcaugacauguugguucaaaaagagcggugaauggaucaugggcguucuguccgggaacuggaugguggucgcugugcuaaucacccuccugguuuugucaauuuuucuguucgccuuaugcuguccucgucgggcagcguauaaaaaggagcacaagcccuga

SEQ ID NO: 10172 - RNA, 3447 nt, Artificial Sequence
  derived and/or modified CDS sequence (opt3) from MUV(11-4)__JX046483.1__GP
augggcaagauuagccccguguaccugugccuccuucugcagggguuguuacuguggagagacggacuagccaggaaccucaaugagcugaaaauggaauguccucacaccauuggucuuggccaagggcuggucauaggauccguugaguugccaccggugccccuccggcagguagaaucucugaagcuggagucaaguugcaacuucgaucuccauacaagcacugcuacgcagcaguccuuuaccaaauggaucugggaaucuaagaaugacuuaacagauucgacucaagcaucaagcaccaguuaucagacaaaauccaccgaggugaaccugaagggccuuuguuuggucccuacucuggugauugagacagccgcgcgcacccgaaagacgaucgcuugcuucgaccuaucuuguaaucagacuguuugccagccaaccguguaccucauuggucccauccaaacauguauaacuaccaaaagcugccugaucgggcuuggagaucagcguauucaggucaacuaugaaaagacauacuguguguccggccagcugguagagggcguuugcuuuaauccuauccacaccauggccuugucacaaccaagucauacguaugacguggucacuaugauggugagauguuuccucguggucaaaaagguuacaagcggggauucuaugaaaauugaaaagaacuuugagacccuggugcagaagacuggaugcuccaauaacaauuuccaggguuacuauguaugcuuaaucggcucaagcagugagccccuguacgugccuacacucgacgauuacaggucugcagaaauacuuucccggauggccuuugcuccacacggggaggaccaugauauugaacgcaacgcaaucagcgccaugagaauugucggaaaagugaccggcaaggcuccgucgucugaguccucagacacgguucaagguaucgccuucagugggaauccccuguauaccagcacaggaguguugacuuccaaagaugacccugucuacgugugggcgccaggcaucauuauggaaggcaaccacucuguaugugacaagaaaacccuaccccugacauggacuggguauauaccucucccaggagagaucgagaagaccacacagugcaccguuuucuguacucuggcaggucccggcgccgauugcgaggcuuacagcgaaacggggauuuucaauaucucaaguccgacaugucuuauaaacagggugcagcgguuucgcggagccgaacagcaaauuaaauucgucugccagcgaguggacauggauaucaccgucuauuguaacggcaucaagaaggugauucugacuaaaaccuugguuaucggucagugcauuuacacauuuaccuccauauucagccucaugccugggguggcacacucucuggcuguagaguuauguguccccggccugcauggaugggccacuaugcuacuccugcuuacauucugcuuuggcuggaucuugauuccaacgaucacccugauccuccugaagauucuucuggcguucgccuauguguguucaaaauacaauacugacaguaaguuuaaaauauugaucgaaaagguuaagcaggaguaccagaaaacaauggggagcauggugugcgaggucugccaacacgaaugugagaccgcaaaggaacucgagucccauaaaaagucuugcccuauuggaucgugucccuauugccugaacccagcugaagccacaacuagcgcuuuacaggcccacuucaaaguguguaagcugaccuccagauuucaggagaaucuaaggaagucacucacgguauacgagcccaaacaagguugcuaucggacccugagucuuuuccguuaccgcucuagauguuuugugggcuugaucuggugcauucugcucacacuggaauuaaucguuugggcagccagcgcugagacucugaaccuuaauccuggguggaccgauacagcgcacggauccggcauagucccaaugaggacugacuuggaacucgauuucucacugccgagcucugcauccuauaccuaccggcgaagucuacagaaccccgccaaugagcaggagcagaucccuuuucaucugcaaauugaaaaacaggugauccacgcugagauucagcaucucggucacuggauggacgccacguucaaccugaaaacagcauuucauuguuauggggccugcgaaaaguacgcuuacccauggcaaaccgccggcuguuucguggagaaagauuuugaauuugagaauggauggggcugcaaucccccugacugcccaggggucggaacugguuguacagcaugcggcgcguaucuugauaaguuaaagagcguugggaaaguguucaagaucgugucucugcgcuacaccagaaaggcuuguauacaguuaggaacugagcagaccugcaagaacguagacuccaacgacugucucgucacaacgucagugaaaguuugccugauuggcaccaucaguaaguuucagcccagcgauacucuucuguucuuggguccgcucgaacaagggggcauuaucuuuaaacagugguguacaaccacaugccaguucggagacccuggcgauauaaugucgacuccaaucgggaugaagugucccgagcugaauggauccuuuaggaagaaaugcucuuucgccaccacgccugugugucaguuugacggcaacacaauuagcgguuauaagcggaugaucgcaaccaaagauucauuccaaaguuuuaaugucacugaaccccacauuuccgccucugcucuagaguggaucgacccagauagcucccugcgcgaccacauaaacgugguuguggggagagaucucccuuuccaggaccugucagaaacccccugccagauugaucuuagcacaaguucuaucgacggagccuggggcuccgguguaggcuuuaacuuggucugcagcgugucgcugacugaguguucaaccuucuuaacaucuaucaaggcaugcgauacggcuauguguuacgggaguaccacugccaaucucgugaggggacagaacacaguccauguugugggcaaagggggacacuccggcagcaaguuuguaugcugucaugacaccaagugcucuaauacuggucugcuugcggccgcuccacaccuggaccgugugacaggguauaaccaagcagauagcgacaaagucuucgaugacggagccccggaguguggcaugaccugcugguucaagaaauccggugaauggauuaugggcgugcuaucagggaauuggaugguuguggcuguccucaucacgcuguuggugcugaguaucuuuuuguucgcccucuguugcccucggcgagcagcguacaagaaagagcacaagcccuga

SEQ ID NO: 10173 - RNA, 3447 nt, Artificial Sequence
  derived and/or modified CDS sequence (opt3) from MUV(11-5)__JX046486.1__GP
augggcaagaucagccccguguaccugugccuccuucugcagggguuguuacuguggagagacggacuagccaggaaccucaaugagcugaaaauggaauguccucacaccauuggucuuggccaagggcuggucauaggauccguugaguugccaccggugccccuccggcagguagaaucucugaagcuggagucaaguugcaacuucgaucuccauacaagcacugcuacgcagcaguccuuuaccaaauggaucugggaaucuaagaaugacuuaacagauucgacucaagcaucaagcaccaguuaucagacaaaauccaccgaggugaaccugaagggccuuuguuuggucccuacucuggugauugagacagccgcgcgcacccgaaagacgaucgcuugcuucgaccuaucuuguaaucagacuguuugccagccaaccguguaccucauuggucccauccaaacauguauaacuaccaaaagcugccugaucgggcuuggagaucagcguauucaggucaacuaugaaaagacauacuguguguccggccagcugguagagggcguuugcuuuaauccuauccacaccauggccuugucacaaccaagucauacguaugacguggucacuaugauggugagauguuuccucguggucaaaaagguuacaagcggggauucuaugaaaauugaaaagaacuuugagacccuggugcagaagacuggaugcuccaauaacaauuuccaggguuacuauguaugcuuaaucggcucaagcagugagccccuguacgugccuacacucgacgauuacaggucugcagaaauacuuucccggauggccuuugcuccacacggggaggaccaugauauugaacgcaacgcaaucagcgccaugagaauugucggaaaagugaccggcaaggcuccgucgucugaguccucagacacgguucaagguaucgccuucagugggaauccccuguauaccagcacaggaguguugacuuccaaagaugacccugucuacgugugggcgccaggcaucauuauggaaggcaaccacucuguaugugacaagaaaacccuaccccugacauggacuggguauauaccucucccaggagagaucgagaagaccacacagugcaccguuuucuguacucuggcaggucccggcgccgauugcgaggcuuacagcgaaacggggauuuucaauaucucaaguccgacaugucuuauaaacagggugcagcgguuucgcggagccgaacagcaaauuaaauucgucugccagcgaguggacauggauaucaccgucuauuguaacggcaucaagaaggugauucugacuaaaaccuugguuaucggucagugcauuuacacauuuaccuccauauucagccucaugccugggguggcacacucucuggcuguagaguuauguguccccggccugcauggaugggccacuaugcuacuccugcuuacauucugcuuuggcuggaucuugauuccaacgaucacccugauccuccugaagauucuucuggcguucgccuauguguguucaaaauacaauacugacaguaaguuuaaaauauugaucgaaaagguuaagcaggaguaccaaaagacaauggggagcauggugugcgaggucugccagcacgaaugugagaccgcaaaggaacucgagucccauaaaaagucuugcccuauuggaucgugucccuauugccugaacccagcugaagccacaacuagcgcuuuacaggcccacuucaaaguguguaagcugaccuccagauuucaggagaaucuaaggaagucacucacgguauacgagcccaaacaagguugcuaucggacccugagucuuuuccguuaccgcucuagauguuuugugggcuugaucuggugcauucugcucacacuggaauuaguugucugggcagccagcgcugagacucugaaccuuaauccuggguggaccgauacagcgcacggauccggcaucgugccaaugaggacugacuuggaacucgauuucucacugccgagcucugcauccuauaccuaccggcgaagucuacagaaccccgccaaugagcaggagcagauaccuuuucaucugcaaaucgaaaaacaggugauucacgcugagauccagcaucucggucacuggauggacgccacguucaaccugaaaacagcauuucauuguuauggggccugcgaaaaguacgcuuacccauggcaaaccgccggcuguuucgucgagaaagauuuugaauuugagaauggauggggcugcaaucccccugacugcccagggguuggaacugguuguacagcaugcggcgcguaucuugauaaguugaaaagcguggggaaaguguucaagauuguaucucugcgcuacaccagaaaggcuuguauccaguuaggaacugagcagaccugcaagaacgucgacuccaacgacugucucgugacaacgucaguuaaagugugccugauaggcaccauuaguaaguuucagcccagcgauacucuucuguucuuggguccgcucgaacaagggggcaucauuuuuaaacagugguguacaaccacaugccaguucggagacccuggcgauaucaugucgacuccaauagggaugaagugucccgagcugaauggauccuuuaggaagaaaugcucuuucgccaccacgccugucugucaguuugacggcaacacaaucagcgguuauaagcggaugauugcaaccaaagauucauuccaaaguuuuaaugugacugaaccccacaucuccgccucugcucuagaguggauugacccagauagcucccugcgcgaccacaucaacguugugguagggagagaucucccuuuccaggaccugucagaaacccccugccagauagaucuuagcacaaguucuauugacggagccuggggcuccggugucggcuuuaacuuggugugcagcgugucgcugacugaguguucaaccuucuuaacaucuaucaaggcaugcgauacggcuauguguuacgggaguaccacugccaaucucgucaggggacagaacacaguucaugugguaggcaaagggggacacuccggcagcaaguuugugugcugucaugacaccaagugcucuaauacuggucugcuugcggccgcuccacaccuggaccgugucacaggguauaaccaagcagauagcgacaaaguguucgaugacggagccccggaguguggcaugaccugcugguucaagaaauccggugaauggaucaugggcguucuaucagggaauuggaugguggucgcugugcucauuacgcuguugguucugaguaucuuuuuauucgcccucuguugcccucggcgagcagcguacaagaaagagcacaagcccuga

SEQ ID NO: 10174 - RNA, 3408 nt, Artificial Sequence
  derived and/or modified CDS sequence (opt3) from SANGV(SA14)__NC_034516.1__GP
augaucauguggggccugcuccuucuggccgcuauuaccuuccccugccagagcuugaagaacguguacgacaugaaaauagaguguccucacuccgucaauuuuggggaaucuucaguuaugggaaaggugcaauuaccaagucugagcaucacagaggcagaacagcuaguaccggaguccucuugcaacauggauaaucaucagucgcucucagugcugcagaaagccacuaagacgaccuggagaaagaaggcggaccacagcaacgcugguaaggauaguuaugaacuuauuacauccgagauccaauucaaaggcgucuguucucugacucauaagaugauugaggaaagccacagguugcggcgcuccgugaucugcuacgaccucucauguaauaccacacauugcaaacccacccuguauaugguugugccuguccacaguuguaacaugaugaaaagcugccugauagggcucggaccauaccgaauccaggugguauaugagcguacuuacuguacaguuggcguguuaaaugaagguaaaugcuuuguccccgaucagucuguggccaacauugugaagaaugggaucuucgacauugucuccguucagaucauauguuucuucauuagaaucaagggaucaaccuauaaaauucuggagacggugaagacugcaaugaacggcaaaugcaauggcaccgaugacaagguacaaggguacuacaucugccuuuugggagguaacagcggcccuaucuaugugccaagugggacagauuuuagggccauggaggcucuggcaaauaugcuacgggcuccccacggagaagaccaugaucucccuggcgaggaacuggcuucuuacuccauugccgguacuauagaggggaaaaucccacacaccgcgagcucgcagaaccuugaauuuacagcauauucuggcauuccguccuacucaaguuuuagcguccauacccugacgcaggacggacaguuguccuauucucccggccucuucccuaaucugaaccaaagcgauuguaagaaaaacgccuuaccacugaucugggaggggacuauagagcuccccggauacuaugaagcuauucacccuugcaauguguuuuguguuuucucagguccaggcgccaguugcgaggcauuuuccgaagggggaaucuucaacaucacaagccccaccugucuugugucuaagcagaaucgcuucagagcugccgagcagcaaauuacuuuugucugccagaggguggacauggacaucauuauauacuguaacggccagcggaagguaauccugacaaaaaccuugguuauuggucagugcaucuacucaaucacgagucuauucagccugcucccguccguggcgcacucuauugccauagaacugugugucccuggguuucauggcugggcaaccgcugcccuucugacaacuuucugcuuuggaugguugcucauccccucgauuaccuauaucgugcuguuaauucugaaguucaucgcugccauauuucacaauacaacucaagagaacaaauucaaggcaauccuacgcaaaauuaaggaggaauuugagaagaccaaaggcagcauggucugugauaucugcaaguacgaaugcgagacagggaaagaacucaaggcccauaaucuguccuguaaccagucacagugcccauauuguuucacccacugcgagaugacugagagugcuuuucaggcgcauuacaaagugugucaagcaacgcaccgauucagagaagaccuuaagaagacaauuaccccucagacuaucucucccggaugcuauaggaccuugaaucuguuucgguacaaaagccguuguuauauacucacaguuuggcugugccuucugauuuuggaguccaucgccugggcugccucagcaagcgaaaccucucucaacccacuguggacugauaaugcccacggugugggcuccguacccaugcauacagacuuagagcuggauuucagucuaccuucuagcuccaaguacacguacaaacgcaagcucaccucaccaacuaacccggagcaggcugucagucugcacauugaaaucgagagccaggggauagccgcagacgugcauucgcuuggacacugguaugaugcgagauugaaucugaaaacauccuuccacuguuacggcgcuugcaccaaguaucaauaccccuggcauacagccaagugucacuuugaacaugacuuccaguaugagaacucuugggguugcaauccuccagauugccccgggguuggcacuggauguaccgcaugcggccucuaccuggaccaguuaaaaccuguggggagcgccuauaagcugaucacggucagguacucacggaaaguguguguacaguuuggagaagagaaccuuugcaagaccauugauaugaacgacuguuucaugagucgacacgugaaaguuugcaucauugguacagucuccaaguuuucucaaggcgacacuuugguguuccucgggccacuggagggaggcggucuaaucuuuaaagauugguguaccagcacaugccaguacggggaccccggcgauauaauguccccgcgcgacagaggauucucauguccugaauuuccaggcagcuucaggaagaagugcaauuuugcuacuacccccgugugugaguauagugggaacauggucucuggauacaaaaagguuauggccacgauugauuccuuccagagcuuuaauacaucgcugauccauuucaccgaggaacggaucgaauggaaagacccugauggcaugcuccgcgaccaccugaacauucuugugacuaaggauaucgacuucgagaauuugggugagaaccccugcaaaguggggcugcaaacaucaucuauugaaggagcauggggcagugguguaggcuuuaccuuagucugccaggugucccucauagauugugcuagauuccugacuagcaucaaggccugcgacauggcgauuuguuauggggcccagucuguuagccuugugaggggacagaauaccgucaagaucacaggcaaagggggacacuccggcucaaguuuuaagugcugucaugagguggauugcagcucuacgggucugcaagccuccgcaccacacuuggacaaaguuaacgggauuucagaacaggagaaugacaagguguacgaugacggagccccucaguguggcguaaguugcugguucgucaaaagcggugaauggaucuccggcauacuccaugggaacugggugguggucguugugcugguaauccuacugcucuuuucucugauucuuuugucgauccugugucccgugcguaagcacaagcggagcuga

SEQ ID NO: 10175 - RNA, 3408 nt, Artificial Sequence; identical to SEQ ID NO: 10174
  derived and/or modified CDS sequence (opt3) from SANGV(SA14)__NC_034516.1__GP

SEQ ID NO: 10176 - RNA, 3402 nt, Artificial Sequence
  derived and/or modified CDS sequence (opt3) from SEOV(L99)__AF288298.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaagguggucuggaggaaaaaggcgaaucaagaauuggcuaaccaaaauucauuugaggugguugagagcgaagugaguuucaaaggccucugcaugcugaagcaccggauggucgaggaauccuaucgcaaccgacguucugugauauguuacgaccuggccugcaauagcaccuuuuguaagcccacaguauauaugaucguuccuauucaugcaugcaacaugaugaaauccugucucaucggguuaggaccauacaggauucagguggucuaugagagaacuuacugcaccacaggcauccugaccgaggguaaguguuucgugcccgauaaagccguggucucagcucuuaagcgggggauguaugcaauagccaguaucgaaacuauuugcuuuuucauccacaaaaagggaaauacauacaagauuguuaccgcuaucacgagcgccaugggcucuaaauguaacaauacugacaccaaggugcagggcuacuauauaugcauuaucgggggaaacuccgcgccuguauacgcaccagccggugaggauuuucgcgcuauggaaguguucucaggcauuaucacaagcccccauggggaggaccacgauuugccuggagaagagaucgccacuuaucaaauuaguggccagauagaggcaaaaaucccacacaccgucucuuccaagagccugaaacuaauugcuuuugccgguaucccgucguacucuuccacaucaauacucgcggccagugaagacgggagauucauuuuuagccccggacuguucccuaaucuuaaccaguccgugugcgauaacaaugcacugccauugaucuggaggggccucaucgaccugaccggcuauuacgaggcuguucaucccuguaacguguucugcgucuuaucugggccuggagccagcugugaggcuuuuucagaagguggcauuuucaauaucacgaguccaaugugccugguguccaagcagaaccgguuucgcgccgcagaacaacagauuagcuucauaugucagcgaguagauauggacaucauuguuuauugcaaugggcagaaaaagacuauccucacaaagacccuugugaucggacaguguauuuacacuauaacaucucuguuuucauugcuacccggcgucgcccacaguaucgcuauugagcugugcgugccggguuuccaugggugggcgaccgcagcccuccugaucacguuuuguuucggcuggguccuuauuccugcuugcacccuggccaucuugcucgugcugaaauuuuucgcaaacauauuacacacaagcaaucaggagaacagauuuaaggccauccugaggaaaauuaaggaagaguucgagaaaacuaagggauccaugguuugugaaaucugcaaguacgaaugcgagacccuaaaagagcucaaggcucacaaucugucuugugugcagggcgaaugccccuauuguuuuacacauugcgagccaacugaaaccgccauucaagcacacuacaaaguaugucaggcgacacaucgguuccgugaggaucuuaagaaaaccgucacuccuaagaacaucgggcccggaugcuaucgcacguugaaucuguucagauacaagucgagguguuauauacucacaauguggacccugcuucugauuaucgagagcauuuugugggcugccuccgcagccgaaaucccacucgugccccuguggacugacaacgcucacgguguuggcucagugccuaugcauaccgacuuagagcuggauuuuagucuaccaucuagcuccaaauacgccuauaagcggcaccucacaaauccggucaacgaccagcagucagugagccugcacauagaaaucgagucucaagggauuggagcagauguacaucaccuuggccauugguacgacgcucgauugaaucugaaaaccuccuuccacugcuacggugccuguacuaaguaucaguaccccuggcacacagcgaaaugccauuuugaaaaggauuaugaguacgagaacaguugggccuguaacccuccagacugccccggggugggcacgggaugcaccgcuuguggccucuaucuggaucaguuaaagccuguugggacugcauucaaaaucauuagcguccgcuacucuagaaaggugugcgugcaguuuggagaagaguaucuguguaaaacaaucgacaugaaugauugcuucgucaccaggcacgccaagauauguauuaucgguacaguuuccaaauuuucacaaggcgacacucuuuuguuccucgggccaauggaaggaggcgguaucauuuuuaagcauuggugcaccaguacgugucacuucggggaucccggcgacgugaugggaccgaaagacaagccuuuuagcugcccagaguuccccggccaguuucggaagaaauguaacuucgcuaccacaccuaucugcgaauacgaugggaauauuauaucgggauacaagaaagugcuggccacuaucgacuccuuccagucuuuuaacaccagcaauauucauuucacagaugagcgcaucgaguggagagaccccgauggcaugcuaagggaccacauuaacaucguaauaucaaaggauaucgacuuugaaaaucuggcagagaguccauguaaagucggucuccaggcggccaacauugaaggggcuuggggauccggcguggguuucacucugaccugccaaguuucucuuacggagugcccuacauuuuugaccagcaucaaggccugugauauggcaauuugcuauggcgcugaauccgugacucugucacgugggcagaauacaguccggaucaccggaaagggcgggcacagcggaaguucuuucaaauguugccauggcaaggaguguuccagcacugguuuacaggccucggcaccccaccucgacaaagugaacgggauaucagagcuggaaaaugagaagguuuacgaugacggagccccagaaugcggcgugaccuguugguuuaaaaagucuggugaguggguaaugggcauuaucaacgggaauugggucgugcuuaucgugcugugcgucuugcuccuguucagucuaauucugcucuccauacuguguccgguucgaaagcauaaaaagagcuga

SEQ ID NO: 10177 - RNA, 3402 nt, Artificial Sequence
  derived and/or modified CDS sequence (opt3) from SEOV(Rn10-134)__JF693883.2__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaggcuuuuucagaagguggcauuuucaacaucacuucaccaaugugcuuagucuccaaacaaaaucgguuucgcgccgcagaacagcagauuagcuucgugugucaacgaguagauauggacauaaucguuuauugcaacgggcagaagaaaacaauucugaccaagacucucgugaucggacaguguaucuacacaauuaccucucuguuuucacuuuugcccggcgucgcccacaguauagcuaucgagcuaugcgugccggguuuccaugggugggcgacggcagcccugcucauuaccuuuuguuucggcuggguccugaucccugcuugcacacuugccauucuguuggugcucaaguuuuucgcaaauauccugcacacuagcaaccaggagaauagauuuaaagccauauuaaggaagaucaaagaagaguucgaaaagaccaaaggauccaugguuugugagauuugcaaguacgaaugcgagacacugaaggagcuaaaagcucacaaccucucuugugugcaaggcgaaugccccuauuguuuuacucauugcgagccaaccgaaacagccauccaggcacacuacaagguaugucaggcgacccaucgguuccgugaggaucugaaaaagacugucacgccucagaauauugggcccggaugcuaucgcacacuuaacuuguucagauacaaaucgagguguuauauccugaccauguggacucuccugcuuauaauugagagcauccugugggcugccuccgcaguggaaauuccauugguuccccucuggaccgacaaugcccacggugugggcucagucccuaugcauacagaccuggaguuagauuuuagucugccaucuagcucccgguacaccuauaagcgacaccuaacuaacccggugaaugaccaacagucaguaagccuccacaucgaaauagagucucaggggaucggagcugaugugcaucaccugggccauugguacgacgcccgccuuaacuugaagacauccuuccacugcuacggugcauguacgaaauaucaguaccccuggcacaccgcuaagugccauuuugaaaaagauuaugaguacgagaacaguugggccuguaauccuccagacugccccgggguuggcacuggaugcacagcguguggccuguaucucgaucaacugaagccugucgggaccgccuucaaaauuaucagcgugagauacucuaggaaggugugcguccaguuuggagaagaguauuuauguaagacaauugacaugaacgauugcuucguuacucggcacgcuaaaaucuguauaauugguaccguguccaaguuuucacagggcgacacgcugcuuuucuuggggccaauggaaggaggcgguaucaucuuuaaacauuggugcaccaguacaugucacuucggggaucccggcgacgugaugggaccgaaggacaaaccuuuuauuugcccagaguuccccggccaguuucgcaagaaauguaauuucgcaacuaccccuguaugcgaauacgaugggaacaucauuagcggauacaagaagguccucgccacaauagacucguuccaauccuuuaauacuucuaacauccauuucaccgaugagagaauugaguggagggaccccgauggcaugcugcgugaccacaucaauauugugaucagcaaagauauagacuuugaaaaccuagcugagaauccauguaagguuggucugcaggccgcaaacaucgaaggggcguggggaucaggcguggguuucacgcucacaugccaggucagucugaccgagugcccuacuuuucuuacauccauuaaagccugugauauggcuaucugcuauggcgccgaaucugugaccuugagccgggggcaaaauacuguuaagauuaccggaaaaggcgggcacuccggaaguagcuucaaguguugccauggcaaggaguguagucugacagguuuacaggcaucugcuccccaccucgacaaagugaacgggaucuccgagcuggaaaaugagaagguauacgaugacggagccccagaaugcggcauaacguguugguuuaaaaagagcggugagugggucaugggcauuaucaacgggaauuggguggugcuuaucguccugugcguuuugcuccuguucucgcuaauucugcucucaauacuguguccggugcgaaaacauaagaagucuuga

SEQ ID NO: 10178 - RNA, 3402 nt, Artificial Sequence
  derived and/or modified CDS sequence (opt3) from SEOV(Gou3-e5)__AF288650.1__GP
auguggggccugcuccuucuggccgcuuugguggggcagggauuagcacugaagaacgucuucgacaugaaaauccaaugcccccacagcguuaauuuuggugagaccuccgugucuggcuacacagaacuaccuccacucccgcugcaggaggccgaacagcuuguacccgagucaaguuguaacauggauaaucaucagagccuguccacuauuaacaaguugacgaaagugauauggagaaagaaagcgaaucaagaaucugcuucgcagaacucauucgaggucguggagaaugaaguuagcuuuaaggggcucugcaugcugaagcacaggaugguggaggaaaguuaucggaaccgccgauccgucaucuguuacgaccuggccugcaauaccacauucuguaaaccuacuguguauaugauuguaccaauccaugcaugcaacaugaugaagucuugucucauuggauuaggccccuaccguauccagguuauauaugagagaaccuacugcacaaccgguauccugacugaggggaaauguuuugugccugauaaggccgucgugagcgcucuuaaaaggggaauguaugcaauugccuccaucgaaacaauuugcuucuuugugcaccagaagggcaauaccuacaagaucgucucagcuauaacgagugccaugggcagcaaauguaacaauacugacucuaagguucaaggguacuauauuugcaucauuggagguaacuccgcgccaguguacgcacccgccggcgaggauuuccgggcuauggaaguauuuucagggaucaucaccagcccucauggagaggaccacgauuugccaggcgaagagauugccacauaucagauaaguggucagaucgaggcaaaaauuccgcacacugugucuuccaagaaucugaaacuaaccgcuuucgccgggauccccagcuacucgucuacauccauacucgcggccucagaagacggacgcuuuauuuucaguccuggccuguuuccaaaccuuaaccagagcgucugcgauaauaacgcacugcccuugaucuggagaggccucaucgaccugaccggguauuacgaggcuauucauccuuguaauguguucugcguuuuauccggaccaggugccucuugugaggcuuucagcgaaggcgggaucuuuaacauuacgucacccaugugccuggugaguaagcaaaauagguuccgggccgcagaacagcagauauccuuuaucugucaacgcgucgauauggacauugugguauauugcaacggacagaaaaagacuauccucacaaagacccuuguuaucggccaguguauuuacacuauaacaagccuguucucuuugcuaccggguguggcccacucaaucgcuauugagcugugcgucccuggguuucauggcugggcgaccgcagcccuccuggugacguucuguuuuggauggguccuuauccccgcuugcacccuggccgugcucuuguuccugaaauuuuucgcaaauauuuuacacacaaguaaccaggagaaucgauuuaaggccauccugagaaaaauaaaggaagaguucgagaaaacuaagggcagcaugguuugugaaaucugcaaguacgaaugcgagacccuaaaagagcucaaggcucacaaccuguccugugugcaaggggaaugcccauauuguuuuacacauugcgagccuacugaaaccgccauucaggcacacuacaaaguaugucaggcgacacauagguuccgggaggaucuuaagaaaaccgucacuccccagaauaucggaccagguugcuaucguacguugaaccuguuccgcuacaagucuagauguuauauucucacaauguggauccugcuucuggugauagagucgauuuugugggcugccagcgcagccgaaaucccccucguuccucuguggaccgacaaugcucacggcgugggguccgucccaaugcauacugacuuagagcuggauuuuucacuaccgaguucuagcaaguacaccuauaaaaggcaccucacaaaccccgugaaugaccaacaguccguaucacugcacauugaaaucgagagccagggaauaggcgccgaugugcaucaccuuggucauugguacgacgcacgguugaaccugaagaccucuuuccacugcuacggggcuuguacuaaauaucaguacccuuggcacacagccaagugccauuuugaaaaagauuaugaguacgagaacuccugggcguguaauccacccgacugcccuggcguuggaacgggcugcaccggguguggacucuaucuggaucaauuaaagccagucgguacugccuucaagaucauuagugugcgauacagccgcaaagugugcguccaguuuggcgaagaguaucuguguaagacaaucgacaugaacgauugcuucguuaccagacacgcuaaaauuuguaucauagggacagugucuaaguuuucccagggagacacucuuuuguuccucggccccauggaaggugggggcauuaucuuuaaacauuggugcaccucaacgugucacuucggagauccgggcgacgugauggggccuaaggacaaaccauuuaucugccccgaguucccuggacaguuuaggaagaaguguaauuucgcaaccacacccguaugcgaauacgauggcaacgucauuagugguuaccggaaagugcuggccacuaucgacagcuuccaaucguuuaauaccuccaacguucauuucacagaugagcgcauugaguggaaggacccagaugggaugcuaagagaccacauaaauaucgugauuucuaaagauaucgacuuugaaaaccuggcugagaauccuuguaaggucggacuccaggccgcaaacauugaaggcgcgugggguagcggcgugggguucacucugaccugccagguuucacuuacggagugccccacauuuuugaccaguaucaaagccugugauauggcuauaugcuauggagccgaauccgugacucugucuaggggccaaaauacaaucaagauuaccgggcguggaggccacagcgguuccucauucaaguguugccaugggaaagaguguagcgcaaacggauuacaggcuagugccccacaccucgacaagguaaauggcaucucugagcuggaaaacgagaaagucuacgaugacggugcaccggaaugcggcauuacuuguugguuuaagaaauccggggagugggugaugggaaucauaaauggcaacugggugguccuuauuguucugugcguguugcuccuguucagccuaauccugcucucgauccuguguccuguacggaagcauaagaaaucauga

SEQ ID NO: 10179 - RNA, 3402 nt, Artificial Sequence
  derived and/or modified CDS sequence (opt3) from SEOV(China)__EU163437.1__GP
auguggagccugcuccuucuggccgcuuuggugggccagggguucgcauuaaagaacgucuuugacaugagaauccaaugcccccacuccguuaaauucggagagaccucugugucagguuacacagaacugccuccacuaagucuccaggaggccgaacagcugguaccggagagcuccuguaauauggauaaccaucagucucuuucgacuauuaauaagcugacgaaagugauauggaggaagaaagcgaaccaagaaucagcuaaucagaacagcuuugagaucuuggagagugaagucuccuucaagggccucugcaugcugaagcaccggaugguggaggaaucuuaucgcaaucgacguagcguuauuuguuacgaccuggccugcaacuccaccuuuuguaaacccacaguguauaugaucgucccuauucaugcaugcaauaucaugaagucaugucucauaggguuaggaccauacagaauccaggugguauaugagaggacuuacugcaccacaggcauucugaccgaggguaaauguuucguucccgauaaggccguggucagugcucuuaaacgggggauguaugcaaucgccagcauugaaacuaucugcuuuuucauacaccagaagggaaacaaguacaaaauugugacagcuaucaccucugccaugggcuccaaguguaauaacacggacacuaaagugcaaggcuacuauauuugcaucaucgggggaaauucagcgccugucuacgcaccagccggugaggauuuucgcgcuauggaaguuuucagcggcauuauaaccaguccccauggggaggaccacgauuugccuggagaagagaucgccacauaucagauuucuggccagaucgaggcaaagauaccacacacuguguccagccagaaccugaaacuaaccgcuuuugccgguauuccgucguacucuuccacaucaauccucgcggccagugaagacgggagauucaucuuuagccccggacuguucccuaaucuuaaccaauccguaugcgauaacaaugcacugccauugauuuggaggggccucaucgaccugaccggcuauuacgaggcugugcaucccuguaacgucuucugcguguuaucugggccuggagccagcugugaagccuuuucagaggguggcauuuucaauauaacgaguccaaugugccugguuuccaagcagaaccgguuucgcgccgcagaacagcaaaucagcuucauuugucagcgaguggauauggacaucaucgucuauugcaaugggcagaaaaagacuauucucacaaagacccuugugauaggacaguguaucuacacuauuacaucucuguuuucauugcuacccggcguagcccacaguaucgcuauugagcugugcguuccggguuuccaugggugggcgaccgcagcccuccugaucacguuuuguuucggcugggugcuuauaccugcuugcacccuggccaucuugcucguccugaaauuuuucgcaaacauuuuacaaacaagcaaucaggagaacagauuuaaggccauccugaggaaaauuaaggaagaguucgagaaaacuaagggauccauggugugugaaaucugcaaguacgaaugcgagacccuaaaagagcucaaggcucacaaucugucuuguguccagggcgaaugccccuauuguuuuacacacugcgagccaacugaaaccgccauacaggcacauuacaaagugugucaagcgacacaccgguuccgugaggaucuuaagaaaaccguuacuccucagaacauugggcccggaugcuaucgcacguugaaucuguucagauacaagucgagguguuauauccucacaauguggacccugcuucugauuaucgagagcauauugugggcugccuccgcagccgaaaucccacucgugccccuguggacugacaacgcucaugguguaggcucagucccuaugcacaccgacuuagagcuggauuuuagucuaccaucuagcuccaaguacacauauaaacggcaucucaccaauccggugaacgaccagcagucaguuagccugcacauugaaaucgagucucaagggauuggagccgaugugcaccaucuuggccacugcuacgacgcacgauugaaucugaagacuuccuuccauuguuacggugcuugcacaaaauaucaguaccccuggcacacggccaagugucacuuugaaaaagauuaugaguacgagaacaguugggcgugcaacccuccagacugccccggggucggcaccggauguacugccugcggccucuaucuggaucaguuaaagccuguggggacagcuuucaagaucauaagcguacgcuacucuagaaaaguguguguucaguuuggagaagaguaucugugcaagaccauugacaugaaugauuguuucgucacaaggcaugcaaaaaucugcaucauugguacuguguccaaguuuucacaaggcgacacccuuuuguuccucgggccaauggaaggaggcgguaucauuuuuaaacacugguguacgaguaccugccauuucggggaucccggcgacgugaugggaccgaaggacaaaccuuuuauauguccagaguuccccggccaguuucggaagaagugcaacuucgccacaacuccugucugugaauacgaugggaauaucauuagcggauacaaaaagguucuggcuaccaucgacucguuccaguccuuuaaccgcucuuauauucacuucacagaugagagaaucgaguggagggaccccgauggcaugcuacgugaccauauaaauaucgugauuagcaaagauaucgacuuugaaaaccuggccgagaauccaugcaaggugggucuccaagcagcgaacauugaaggggccuggggacugggcguagguuucacucuuaccugccaggucucauugacggaguguccuacauuucugaccaguaucaaggcuugcgauauggccauauguuacggcgcagaauccgugacuuuaucucgggggcagaauacaguuaaaauuaccggaaagggcgggcacagcggauccucauucaaaugcugucacggcaaggagugcagcaguacuggucuccaggcuucugcuccccaucuggacaaagugaacgggaucuccgagcuugaaaaugagaaggucuaugaugacggagcaccagaauguggcauuaccugcugguuuaaaaagagcggugagugggugaugggcaucauaaacgggaauuggguugugcugaucguauuguguguccuccugcuauucucgcugauucuccugucaauccuuugcccggugcgaaagcacaaaaagucuuga

SEQ ID NO: 10180 - RNA, 3402 nt, Artificial Sequence
  derived and/or modified CDS sequence (opt3) from SEOV(DPRK08)__JX853576.1__GP
auguggagccugcuccuucuggccgcuuuggugggccagggguucgcauuaaagaacgucuuugacaugagaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaaacugacgaaggugauauggaggaaaaaggcgaaucaagaaucagcuaaccagaauagcuuugaggucguggagagugaaguuuccuucaaaggcuugugcaugcucaagcaccggaugguggaggaaucuuaucgcaaccgacguagcgucaucuguuacgaccuggccugcaauuccaccuuuuguaagcccacaguguauaugauuguaccuauccaugcaugcaacaugaugaaaucaugucugauugggcucggaccauacagaauccagguuguguaugagaggacuuacugcaccacaggcauauuaaccgaggguaaguguuucguccccgauaaagccguggugagugcucugaagcgggggauguaugcaaucgccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccuguguacgcaccagccggugaggauuuucgcgcuauggaaguauucagcggcaucaucacaaguccccauggggaggaccacgaucuuccuggagaagagauugccacuuaucagauaucuggccagaucgaggcaaagauuccacacaccguguccagcaaaaauuugaagcugacagcuuuugccgguaucccgucguacucuuccaccucaauacuagcggccagugaagacgggagauucauuuuuagccccggacucuucccuaaccugaaccaguccgucugcgauaauaacgcacuuccacugaucuggaggggcuugaucgaccucacgggcuauuacgaggcugugcaucccuguaauguuuucugcgugcugucugggccuggagccagcugugaagccuuuucagaggguggcauuuucaacaucacuucaccaaugugcuuagucuccaaacaaaaucgguuucgcgccgcagaacagcagauuagcuucgugugucaacgaguagauauggacauaaucguuuauugcaacgggcagaagaaaacaauucugaccaagacucucgugaucggacaguguaucuacacaauuaccucucuguuuucacuuuugcccggcgucgcccacaguauagcuaucgagcuaugcgugccggguuuccaugggugggcgacggcagcccugcucauuaccuuuuguuucggcuggguccugaucccugcuugcacacuugccauucuguuggugcucaaguuuuucgcaaauauccugcacacuagcaaccaggagaauagauuuaaagccauauuaaggaagaucaaagaagaguucgaaaagaccaaaggauccaugguuugugagauuugcaaguacgaaugcgagacacugaaggagcuaaaagcucacaaccucucuugugugcaaggcgaaugccccuauuguuuuacucauugcgagccaaccgaaacagccauccaggcacacuacaagguaugucaggcgacccaucgguuccgugaggaucugaaaaagacugucacgccucagaauauugggcccggaugcuaucgcacacuuaacuuguucagauacaaaucgagguguuauauccugaccauguggacucuccugcuuauaauugagagcauccugugggcugccuccgcagccgaaauuccauuggugcccaucuggaccgacaaugcucacgguguuggcucagugccuaugcauacagaccucgagcuggauuuuaguuuaccaucuagcuccaaguacaccuauaagcggcaccugacuaacccggucaaugaccaacagucagugagccuacacauagaaaucgagucucaggggauuggagccgauguacaucaccucggccauugguacgacgcacgacugaaccuuaaaacauccuuccacugcuacggugcuuguacgaaguaucaguaccccuggcacaccgccaaaugccauuuugaaaaggauuaugaguacgagaacaguugggcguguaauccuccagacugccccggggugggcacuggaugcacagccuguggcuuguaucuggaucaacucaaaccuguugggaccgcuuucaagaucauuagcguccgcuacucuagaaaggugugcaugcaguuuggagaagaguaucuguguaaaacaaucgacaugaacgauugcuucgugacuaggcacgcaaagauauguauuaucgguaccgucuccaaauuuucacagggcgacacguuacuguuccuugggccaauggaaggaggcgguaucauuuuuaagcauuggugcaccaguacaugucacuucggggaucccggcgacguuaugggaccgaaagacaagccuuuuaucugcccagaguuccccggccaguuucggaaaaaguguaauuucgccacuaccccugugugcgaauacgaugggaacauuauaagcggauacaagaaaguguuggcuacaaucgacucguuccaauccuuuaauacuucuaacauucauuucaccgaugagcgcaucgaguggagagaccccgauggcaugcucagggaccacauuaauaucguaauaagcaaggauaucgacuuugaaaaccuggccgagaauccauguaaagucggucuacaggcagcgaacauugaaggggccuggggaucaggcguggguuucacgcugacaugccagguuagucucaccgagugcccuacuuuucugacauccaucaaggcuugugauauggccauuugcuauggcgcagaaucugugacccuuagccgugggcaaaauacugucaaaaucaccggaaagggcgggcacuccggaaguagcuucaaguguugccauggcaaagaguguaguucuacagguuugcaggcuuccgcuccccaccuggacaaggugaacgggauaagcgaguuagaaaaugagaaaguuuacgaugacggagcaccagaaugcggcgugacguguugguuuaagaaaucgggugaguggguaaugggcauuaucaacgggaauugggucgugcucaucgugcugugcguccuucuguuguucucacucauucugcuaucuauacuguguccgguucggaagcauaagaaaaguuga

SEQ ID NO: 10181 - RNA, 3402 nt, Artificial Sequence
  derived and/or modified CDS sequence (opt3) from SEOV(Fj372/2013)__KP645197.1__GP
auguggagccugcuccuucuggccgcuuuggugggccccggguucgcauuaaagaacgucuuugacaugagaauccagugcccucacuccguuaauuucggagagaccucugugucagguuacacagaacugccaccgcuaagucuccaagaggccgaacagcugguacccgagagcuccuguaacauggauaaucaucagucucuuucgacuauuaacaaacugacgaaggugauauggcagaaaaaggcgaaucaagaaucagcuaaccagaauagcuuugaggucguggagagugaaguuuccuucaaaggcuugugcaugcucaagcacaggaugguggaggaaucuuaucggaaccgccgaagcgucaucuguuacgaccuggccugcaauuccaccuuuuguaagccuacaguguauaugauuguaccaauccaugcaugcaacaugaugaaaucaugucugauugggcucggacccuaccguauccagguuguguaugagagaacuuacugcaccacaggcauauuaaccgaggguaaguguuucgucccugauaaagccguggugagugcucugaagagggggauguaugcaaucgccagcauugaaacuaucugcuuuuucauucaccagaaaggaaauacauacaagaucgucaccgcuauaacgucugccaugggcuccaaguguaacaauacugacaccaaaguucaaggcuacuauauuugcaucauugggggaaacucagcgccaguguacgcacccgccggugaggauuuucgggcuauggaaguauucagcggcaucaucacaaguccucauggggaggaccacgaucuuccaggagaagagauugccacuuaucagauaucuggccagaucgaggcaaagauuccgcacaccguguccagcaaaaauuugaagcugacagcuuuugccgguauccccucguacucuuccaccucaauacuagcggccagugaagacgggcgcuucauuuuuagcccuggacucuucccaaaccugaaccaguccgucugcgauaauaacgcacuuccccugaucuggagaggcuugaucgaccucacgggcuauuacgaggcugugcauccuuguaauguuuucugcgugcugucugggccaggagccagcugugaggcuuuuucagaagguggcauuuucaacaucacuucacccaugugcuuagucuccaaacaaaauagguuucgggccgcagaacagcagauuagcuucgugugucaacgcguagauauggacauaaucguuuauugcaacgggcagaagaaaacaauucugaccaagacucucgugaucggacaguguaucuacacaauuaccucuuuguuuucacuguugccgggcgucgcccacaguauagcuaucgagcuaugcgugccugguuuccaugggugggcgacggcagcccugcucauuaccuuuuguuucggcuggguccugauccccgcuugcacacuugccauucuguuggugcucaaguuuuucgcaaauauccugcacacuagcaaccaggagaaucgauuuaaagccauauuaagaaagaucaaagaagaguucgaaaagaccaaaggauccaugguuugugagauuugcaaguacgaaugcgagacacugaaggagcuaaaagcucacaaccucucuugugugcaaggcgaaugcccauauuguuuuacucauugcgagccuaccgaaacagccauccaggcacacuacaagguaugucaggcgacccauagguuccgggaggaucugaaaaagacugucacgccccagaauauugggccaggaugcuaucguacacuuaacuuguuccgcuacaaaucgagauguuauauccugaccauguggacucuccugcuuauaauugagagcauccugugggcugccuccgcagccgaaauucccuuggugccucucuggaccgacaaugcucacgguguuggcucagugccaaugcauacagaccuggaguuagauuuuagucugccgucuagcuccaaguacaccuauaagaggcaccuaacuaaccccgucaaugaccaacagucagugagccuccacaucgaaauagagucucaggggaucggagccgauguacaucaccugggccauugguacgacgcacggcuuaacuugaaaacauccuuccacugcuacggugcuuguacgaaguaucaguacccuuggcacaccgccaaaugccauuuugaaaaggauuaugaguacgagaacaguugggcguguaauccacccgacugcccuggggugggcacuggaugcacagccuguggccuguaucucgaucaacugaaaccaguugggaccgcuuucaagauuaucagcguccgauacucucgcaaggugugcgugcaguuuggagaagaguauuuauguaaaacaauugacaugaacgauugcuucgucacuagacacgcaaagaucuguauaauugguaccguuuccaaauuuucacagggcgacacgcugcuuuucuuggggcccauggaaggaggcgguaucaucuuuaagcauuggugcaccaguacaugucacuucggggauccgggcgacgugaugggaccuaaagacaagccauuuauuugccccgaguucccuggccaguuuaggaaaaaguguaauuucgccacuacccccgugugcgaauacgaugggaacaucauuagcggauacaagaaaguacucgcuacaauagacucguuccaauccuuuaauacuucuaacauccauuucaccgaugagcggauugaguggcgcgacccagauggcaugcugagagaccacaucaauauugucaucagcaaggauauagacuuugaaaaccuagccgagaauccuuguaaagugggucugcaggcagcgaacaucgaaggggccuggggaucaggcguugguuucacgcucacaugccaggugagucugaccgagugccccacuuuucuuacauccauuaaggcuugugauauggccaucugcuauggcgcagaaucugucaccuugagcagggggcaaaauacugugaaaauuaccggaaagggcgggcacuccggaaguagcuucaaguguugccauggcaaagaguguaguucuacaggucugcaggcuuccgccccacacuuagacaagguuaacgggaucagcgagcucgaaaaugagaaaguguacgaugacggagcaccggaaugcggcauaacguguugguuuaagaaaucgggugaguggguaaugggcauuaucaacgggaauugggucgugcugaucgugcuuugcguccugcuucucuucucacugauucuacugucuauacucuguccuguucguaagcauaagaaaaguuga

SEQ ID NO: 10182 - RNA, 3402 nt, Artificial Sequence
  derived and/or modified CDS sequence (opt3) from SEOV(HeB38)__JN377554.1__GP
auguggagccugcuccuucuggccgcuuuggugggccagggguucgcauuaaagaacgucuuugacaugagaauccaaugcccccacuccguuaaauucggagagaccucugugucagguuacacagaacugccuccacuaagucuccaggaggccgaacagcugguaccggagagcuccuguaauauggauaaccaucagucucuuucgacuauuaauaagcugacgaaagugauauggcaaaagaaagcgaaccaggaaucagcuaaucagaacagcuuugaggucgccgagagugaaguguccuucaagggcuugugcaugcucaagcacaggaugguugaggaaucuuaucggaaucgccgaagcgugaucuguuacgaccuggcaugcaacuccaccuuuuguaaacccacagucuauaugauugugccuauccaugccugcaauaugaugaagucaugucugauugggcucggaccauaccguauccagguaguuuaugagagaacuuacugcaccacaggcauauuaaccgaggguaaauguuucgugcccgauaaggcugucgugagugcacugaaaagggggauguaugccaucgcuagcauugaaacuaucugcuuuuucauucaccaaaagggaaacacauacaagaucgugaccgccauaacgucugcgaugggcuccaaauguaauaacacugacaccaagguccagggcuacuauauuugcaucauugggggaaauucagcaccuguuuacgccccaagcggugaggauuuucgggcuauggaaguguucaguggcaucaucaugucuccccauggggaggaccacgaucuuccuggagaagagauugccacauaucagauauccggccagaucgaggcaaaaauuccacacacuguaagcucgaagaacuugaaacugaccgcuuuugccgguaucccgucuuacuccucaacaaguauacuagcggccagcgaagacgggcgcuucaucuuuucccccggacucuucccuaaucugaaccaaucugugugcgauaacaaugcacuuccacugauuuggagaggcuugaucgaccucaccggcuauuacgaggcuguccaucccuguaacguguucugcguucugagcgggccuggagccucaugugaagccuuuagugaggguggcauuuucaauaucacguccccaaugugcuuagugagcaagcagaacagguuucgggccgcagaacagcaaauuucuuucgucugucagcgcguggauauggacauaaucguauauugcaaugggcagaaaaagacuauucugacaaagacccucguuaucggacaguguaucuacacuauuacaucacuuuuuagucuguugcccggcguggcccacagcauagcuaucgagcuaugcgucccggguuuccaugggugggcgaccgcagcccugcucauuacguuuuguuucggcugggugcugaucccugcuugcacccuugccauucuguugguccucaaauuuuucgcaaacauccugcacacauccaaucaagagaaccgauuuaaggccauauuaagaaaaaucaaggaagaguucgagaaaacuaagggaucuauggugugugaaauuugcaaguacgaaugcgagacccugaaagagcuaaaggcucacaaucucucguguguucagggcgaaugccccuauuguuuuacacauugcgagccaacugaaaccgccauccaggcacacuacaaagugugucaggcgacacauagguuccgggaggaucugaagaaaaccguaacuccucaaaacauugggcccggaugcuaucguacgcuuaauuuguuccgcuacaagagcagauguuauauccugacaauguggacccuccugcuuauaauugaguccauccugugggcugccucagcagccgaaauuccauuggucccccucuggacugacaacgcucacggugugggcaguguuccuaugcauaccgaccuggaguuagauuuuucucugccaagcuccucaaaguacacauauaaaaggcaccuaaccaauccggugaacgaccagcagagcgucucucuccacaucgaaauagagucccaggggaucggagccgaugugcaucaccugggccauugguacgacgcacggcuuaauuugaagacuucauuccacugcuacggugcuuguacaaaauaucaauaccccuggcacacggccaagugccauuuugaaaaagauuaugaguacgagaacagcugggcguguaacccuccagacugccccgggguaggcaccggaugcacugccuguggccuguaucucgaucagcugaagccuguggggacagcuuucaagauuaucucuguucgauacucccgcaaagucugcgugcaguuuggagaagaguauuuauguaagaccauugacaugaaugauugcuucgugacaagacacgcaaaaaucuguauaauugguacugucucaaaguuuagucagggcgacacccugcuuuucuuggggccaauggaaggaggcgguaucaucuuuaaacauuggugcacgagcaccugucacuucggggaucccggcgacguuaugggaccgaaggacaaaccuuuuauuugcccagaguuccccggccaauuuaggaagaaguguaacuucgccacaacuccugugugcgaauacgaugggaauaucauuucgggauacaaaaaggugcucgcuaccauagacuccuuccagucuuuuaacacaagcaauauccauuucacugaugagcggauugaguggcgcgaccccgauggcaugcugagagaccacaucaacauuguaaucucaaaagauauagacuuugaaaaucuagccgagaacccauguaaggucggucugcaggcagcgaauaucgaaggggccuggggaaguggcguggguuucacccucacgugccaaguuucccugacagagugcccuaccuuucuuacuucuauuaaggcuugugauauggccaucugcuauggcgcagaaagcgugacauugcugagggggcagaacaccgucaaaauuacuggaaagggcgggcacuccggaaguagcuucaaauguugccauggcaaggaguguaguucuaccgguuuacaggcuuccgcuccccaccucgacaaagugaaugggaucagcgagcuggaaaacgagaagguuuacgaugacggagcaccagaaugcggcauaacauguugguuuaaaaagucgggugagugggugaugggcauuaucaaugggaacuggguaguccuuaucgugcugugcguguugcuccuguucucacuaauucugcucucuauacuguguccgguccguaagcauaaaaagaguuga

SEQ ID NO: 10183 - RNA, 3402 nt, Artificial Sequence
  derived and/or modified CDS sequence (opt3) from SEOV(JiangxiXinjianRn-07-2011)__KP859513.1__GP
auguggagccugcuccuucuggccgcuuuggugggccagugcuucgcauuaaagaacgucuuugacaugagaauccaauguccccacuccguuaauuucggggagaccucugugucaggauacacagaacugccuccacuaagucuccaggaggccgaacagcugguaccggagagcuccugcaacauggauaaucaucagucucuuucgacuauuaacaaacugacgaaggugauauggaggaaaaaggcgaaucaagaaucagcuaaccagaauagcuuugaggucguggagagugaaguuuccuucaaagguuuguguaugcucaagcaccggaugguggaggaaucuuaucgcaaccgacguagcgucaucugcuacgaccuggccuguaauuccaccuuuugcaagcccacaguguauaugauuguaccuauccaugcauguaacaugaugaaaucaugccugauuggccucgggccauacagaauccagguuguguaugagaggacuuacuguaccacaggaauauuaaccgagggcaagugcuucguccccgauaaagccguggugagugcucugaagcgggguauguaugcaaucgccagcauugaaacuaucugcuuuuucauucaccagaaagggaauacauacaagaucgucaccgcuauaacgucugccaugggauccaaguguaacaauacugacaccaaaguucaaggcuacuauauuugcaucauuggcgggaacucagcgccuguguacgcaccagccggagaggauuuucgcgcuauggaaguauucagcgguaucaucacaaguccccauggcgaggaccacgaucuuccuggggaagagauugccacuuaucagauaucuggacagaucgaggcaaagauuccacacaccguguccagcaaaaauuugaagcugacagcuuuugccggcaucccgucguacucuuccaccucaauacuagcggccagugaagacgguagauucauuuuuagccccgggcuuuucccuaaccugaaccaguccgucugugauaauaacgcacuuccacugaucuggaggggauugaucgaccucacgggcuauuacgaggcugugcaucccugcaauguuuucugugugcugucuggcccuggggccagcugcgaagccuuuucagagggagguauuuucaacaucacuucaccaauguguuuagucuccaaacaaaaucgguuucgcgccgcagaacagcagauuagcuucgugugccaacgaguagauauggacauaaucguuuauuguaacggccagaagaaaacaauucugaccaagacucucgugaucgggcagugcaucuacacaauuaccucucucuuuucacuguugcccggagucgcccacaguauagcuaucgagcuaugugugccgggcuuccaugguugggcgacggcagcccugcucauuaccuuuugcuucggguggguccugaucccugcuuguacacuugccauucuguuggugcucaaguuuuucgcaaauauccugcacacuagcaaccaggagaauagauuuaaagccauauuaaggaagaucaaagaagaguucgaaaagaccaaaggcuccaugguuugcgagauuugcaaguacgaaugugagacacugaaggagcuaaaagcucacaaccucucuugcgugcaaggagaaugucccuauugcuuuacucauugugagccaaccgaaacagccauccaggcacacuacaagguaugccaggcgacccaucgguuccgugaggaucugaaaaagacugucacgccucagaauauuggccccggguguuaucgcacacuuaacuuguucagauacaaaucgaggugcuauauccugaccauguggacucuccugcuuauaauugagagcauccugugggcugccuccgcagccgaaauuccauuggugccccucuggaccgacaaugcucacggaguugguucagugccuaugcauacagaccuggaguuagauuuuagucugccaucuagcuccaaguacaccuauaagcggcaccuaacuaacccggucaaugaccaacagucagugagccuccacaucgaaauagagucucagggcaucggggccgauguacaucaccugggacauugguacgacgcacgacuuaacuugaaaacauccuuccacuguuacggcgcuugcacgaaguaucaguaccccuggcacaccgccaaaugucauuuugaaaaggauuaugaguacgagaacaguugggcgugcaauccuccagacugccccgguguggggacuggcuguacagccugcggacuguaucucgaucaacugaaaccuguuggcaccgcuuucaagauuaucagcguccgcuacucuagaaaggugugugugcaguuuggggaagaguauuucugcaaaacaauugacaugaacgauuguuuugucacuaggcacgcaaagaucugcauaauuggaaccguuuccaaauucucacagggugacacguuacuguuucuuggcccaauggaagggggaggcaucaucuucaagcauugguguaccaguacaugccacuuuggugaucccggggacgugaugggcccgaaagacaagccuuucauuuguccagaguuucccggacaguuccggaaaaagugcaauuucgccacuaccccugugugugaauacgauggcaacaucauuagcggguacaagaaaguauuggcuacaauagacucguuucaauccuucaauacuucuaacauccauuuuaccgaugagcgcauugaguggagagaccccgauggaaugcucagggaccacaucaauauugucaucagcaaggauauagacuucgaaaaccuggccgagaauccaugcaaagugggccuacaggcagcgaacaucgaaggugccugggggucaggaguuggcuuuacgcugacaugccaggugagucucaccgaguguccuacuuuccugacauccauuaaggcuugcgauauggccaucuguuauggugcagaaucugucacccuuagccguggccaaaauacugugaaaauuaccgggaagggaggccacuccgggaguagcuuuaagugcugucauggaaaagagugcaguucuacaggcuugcaggcuuccgcuccccaccuggacaagguuaacgguaucagcgaguuagaaaaugagaaaguguacgaugacggggcaccagaauguggaauaacgugcugguucaagaaaucgggcgaguggguaauggguauuaucaacggcaauugggucgugcucaucgugcuguguguccuucuguuguuuucacucauucugcuaucuauacugugcccgguucggaagcauaagaaaaguuga

SEQ ID NO: 10184 - RNA, 3402 nt, Artificial Sequence
  derived and/or modified CDS sequence (opt3) from SEOV(LYON/Rn/FRA/2013/LYO852)__KF387724.1__GP
auguggagccugcuccuucuggccgcuuuggcaggccagggguucgccuuaaagaacguguuugacaugagaauccaaugcccccacuccgucaauuucggagagaccucuguuucagguuacacagaacugccuccacuaagucuccaggaggcggaacagcuggugccggagagcuccuguaacauggauaaucaucagucucuuucgacuauuaacaaacugacgaagguaauauggaggaaaaaggcuaaucaagaaucagccagccagaacaguuuugagguggucgaguccgaagugucuuucaaaggcuugugcaugcuccggcaccgcaugguugaggaaagcuauaagaaucgacguuccgugaucuguuacgaccuggcaugcaacucaaccuuuuguaagcccacagucuauaugauugugccuauccaugccugcaauaugaugaaaaguugucugauugggcucggaccauacagaauccagguaguuuaugagaggacuuacugcaccacaggcauauuaaccgaggguaaguguuucgugcccgauaaagcugucgugagcgcacugaagcgggggauguaugccaucgcuucuauugaaacuaucugcuuuuucauucaccagaaaggaaacacauacaagaucgugaccgccauaacguccgcgaugggcucaaaguguaauaacacugacaccaaaguccaaggcuacuauauuugcaucauugggggaaauagcgcaccuguuuacgccccagcuggugaggauuuucgcgccauggaaguguucaguggcaucaucacaucuccccauggggaggaccacgaucuuccuggagaagagauugcaacuuaucagauauccggccagaucgaggcuaagauuccacacaccguaagcucgaaaaacuugaagcugacagccuuugcggguaucccgucuuacuccucaaccaguauacuagccgcaagcgaagacgggagauucauuuuuagccccggacucuucccuaaucugaaccagucugugugcgauaacaaugcccuuccacugaucuggaggggcuugaucgaccucacgggcuauuacgaggcuguccaucccuguaacguguucugcguucugagcgggccuggagcuucaugugaagccuuuagugaggguggcauuuucaauaucacuuccccaaugugcuuagugagcaaacaaaaccgguuucgcgcagccgaacagcagauuucuuucgucugucaacgaguggauauggacauaaucguauauugcaaugggcagaagaaaacaauucugaccaagacucucguuaucggacaguguaucuacacaauuaccucacuuuuuagucuguugcccggcguggcucacagcauagcgaucgagcuaugcgucccggguuuccaugggugggcaacggccgcucugcucauuaccuuuuguuucggcugggugcugaucccugccugcacacuugcaauucuguugguccucaaguuuuucgccaacauccugcacacuuccaaucaggagaacagauuuaaagcuauauuaaggaagaucaaagaagaguucgaaaagaccaaaggaucuauggugugugagauuugcaaguacgaaugcgagacacugaaggagcuaaaagcccacaaucucucguguguucaaggcgaaugccccuauuguuuuacucauugcgagccaaccgaaacagcaauccaggcgcacuacaaggugugucaggcuacccaucgguuccgugaggaucugaaaaagacuguaacgccucagaacauugggcccggaugcuaucgcacacuuaauuuguucagauacaaauccagguguuauauccugaccauguggacucuccugcuuauaauugaguccauccugugggccgcaucagccgcugaaauuccauuggucccccucuggaccgacaacgcccacggugugggcaguguuccuaugcauacagaccuggaguuagauuuuucucugccaagcuccucaaaguacaccuauaagcggcaccuaacuaauccggugaacgaccaacagagcgucucucuccacaucgaaauagagucccaggggaucggagcagaugugcaucaccugggccauugguacgacgcucgacuuaauuugaaaacaaguuuccacugcuacggugccuguacgaaguaucaguaccccuggcacaccgcgaaaugccauuuugaaaaggauuaugaguacgagaacagcugggccuguaacccuccagacugccccgggguaggcacuggaugcacagcuuguggccuguaucucgaucaacugaaaccuguggggaccgcauucaagauuaucucuguucgcuacuccagaaaggucugcgugcaguuuggagaagaguauuuauguaaaacaauugacaugaaugauugcuucgugacuaggcacgccaagaucuguauaauugguaccgucucaaaauuuagucagggcgacacgcugcuuuucuuggggccaauggaaggaggcgguaucaucuuuaagcauuggugcaccagcacaugucacuucggggaucccggcgacguuaugggaccgaaagacaagccuuuuauuugcccagaguuccccggccaguuucggaaaaaguguaacuucgcuacuaccccugugugcgaauacgaugggaauaucauuucgggauacaagaaagugcucgccacaauagacuccuuccaaucuuuuaacacuagcaauauccauuucaccgaugagcgcauugaguggagagaccccgauggcaugcugagggaccacaucaacauuaucauaucaaaggauaucgacuuugaaaaucuagcagagaacccauguaaaguaggucugcaggcggccaauauugaaggggcuuggggaaguggcgucgguuucacgcucacaugccaggugucccugaccgagugcccuacuuuucuuacaucuaucaaggccugugauauggcaauuugcuauggcgcugaaagcguuaccuugucccgugggcaaaacacugugaaaaucaccggaaagggcgggcacucaggaagcaguuucaaguguugccauggcaaagaguguucucugacagguuuacaggccuccgcaccccaccucgacaaggucaaugggauaagcgagcuggaaaacgagaaaguguacgaugacggagccccagaaugcggcauuacguguugguuuaagaaaucgggugaguggguuaugggcaucaucaaugggaacugggugguacuuauuguccugugcguguucuugcucuuuucacugauacuacugucuauccucuguccggugcggaagcauaagaaaaguuga

SEQ ID NO: 10185 - RNA, 3402 nt, Artificial Sequence
  derived and/or modified CDS sequence (opt3) from SEOV(Seoul-Baxter/NYC-D1_M)__KJ950863.1__GP
auguggagccugcuccuucuggccgcuuuggugggccagggguucgcauuaaagaacgucuuugacaugaaaauccaaugcccccacuccguuaauuucggagagaccucugugucagguuacacagaacugccuccacuaagucuccaggaggccgaacagcugguaccggagagcuccuguaacauggauaaucaucagucucuuucgacuauuaacaagcugacgaaagugauauggagaaagaaagcgaaucaagaaucagcuaaccagaauagcuuugaggucgccgagagugaaguguccuucaagggcuugugcaugcucaagcacaggaugguugaggaaucuuaucggaaccgccgaagcgugaucuguuacgaccuggcaugcaauuccaccuuuuguaaacccacagucuauaugauugugccuauccaugccugcaacaugaugaagucaugucugauugggcucggaccauaccguauccagguaguuuaugagagaacuuacugcaccacaggcauauuaaccgaggguaaauguuucgugcccgauaaggcugucgugagugcacugaaaagggggauguaugccaucgcuagcauugaaacuaucugcuuuuucauucaccagaagggaaauacauacaagaucgugaccgccauaacgucugcgaugggcuccaaauguaacgacacugauaccaagguccaaggcuacuauauuugcaucauugggggaaauucagcaccuguuuacgccccagcuggugaggacuuucgggccauggaaguguucagcggcaucaucacaaguccccauggggaggaucacgaccuuccuggagaagagauugcaacuuaucagauaucuggccagaucgaggcuaaaauuccacacaccguauccagcaagaacuugaaacugacagccuuugcggguaucccgucguacucuuccaccucaauacuagccgcaagugaagaugggcgcuucauuuuuagccccggacucuucccuaaucugaaccaguccgugugcgacaacaaugcccuuccacuggucuggagaggcuugaucgaucucacgggcuauuacgaggccgugcaucccuguaacguuuucugcgugcugucugggccuggagcuagcugugaagccuuuucagaggguggcaucuucaauauuacuucaccaaugugcuuagucuccaagcaaaacagguuucgggcagccgaacagcagaucagcuucgugugucaacgcguagacauggauauuauaguuuauugcaaugggcagaaaaagacaauccugaccaagacucucgugauuggacaguguaucuacacaaucaccucuuuguuuucacuguugcccggcgucgcucacaguauugcgauagagcuaugcgugccggguuuccaugggugggcaacggccgcucugcucaucaccuuuuguuucggcuggguccugauuccugccugcacacuugcaauccuguuggugcucaaauuuuucgccaacauucugcacacuagcaaucaggagaaccgauuuaaggcuaucuuaagaaaaauaaaggaagaguucgagaaaaccaagggauccaugguuugugaaaucugcaaguacgaaugcgagacacugaaagagcuaaaggcccacaaucucucuugugugcaaggcgaaugccccuauuguuuuacucauugcgagccaaccgaaacagcaauucaggcgcacuacaaaguaugucaggcuacccauagguuccgggaggaccugaagaaaacugucacgccucagaacaucgggcccggaugcuaucguacacuuaauuuguuccgcuacaagucgagauguuauauucugaccauguggacucuccugcuuaucauagagagcauucugugggccgcauccgccgcugaaaucccauuggugccccucuggaccgacaacgcccacgguguuggcucagugccuaugcauacagaucuggaguuagacuuuagucugccaucuagcuccaaguacaccuauaaaaggcaccuaacuaauccggucaacgaucaacagucagugagccuccacauugaaaucgagucucaggggauaggagcagacguacaucaccugggccauugguacgaugcucggcuuaauuugaagacauccuuccacugcuacggugccuguacgaaauaucaguaccccuggcacaccgcgaagugccauuuugaaaaagacuaugaguacgagaacaguugggccuguaacccuccagauugccccggggugggcacuggaugcacagcuuguggccuguaucucgaccaacugaagccuguugggaccgcauucaagaucauuagcguccgauacucucgcaaagugugcuuacaguuuggagaagaguaucuguguaagacaaucgauaugaaugacugcuucgugacuagacacgucaaaauuuguaucauagguaccguuuccaaguuuucacagggcgauacgcuuuuguuccucgggccaauggaaggaggcgguauuaucuuuaaacauuggugcaccaguacaugucacuucggggaccccggcgacgugaugggaccgaaggauaaaccuuuuaucugcccagaguuccccggccaguuuaggaagaaguguaacuucgccacuaccccugugugcgaauacgacgggaauauuaucagcggauacaaaaagguacuggcuacaauugauucguuccaauccuuuaacacuucuaauauacauuucaccgacgagcggaucgaguggcgcgaucccgacggcaugcuaagagaucacauuaacaucgucauuagcaaagacaucgauuuugaaaaucuggccgagaacccauguaaggugggucuccaggcagcgaauauagaaggggccuggggaucaggcguugguuucacgcugacaugccaggugagucuuaccgagugcccuacuuuucuuacauccaucaaggcuugugacauggccauuugcuauggcgcagaaucugucacccugagcagggggcaaaacacugugaaaaucaccggaaagggcgggcacuccggaaguagcuucaaauguugccauggcaaggaguguaguucuacagguuuacaggcuuccgcuccccaccucgauaaaguuaaugggauuagcgagcuggaaaacgagaagguguacgacgauggagcaccagaaugcggcaucacguguugguuuaaaaagucgggugaguggguaaugggcauaauuaaugggaacugggucgugcuuaucgugcugugcgucuugcuccuguucucacuaauccugcucucuauucuguguccgguucguaagcauaaaaagaguuga

SEQ ID NO: 10186 - RNA, 3402 nt, Artificial Sequence
  derived and/or modified CDS sequence (opt3) from SEOV(Singapore/06(RN41))__GQ274942.1__GP
auguggagccugcuccuucuggccgcuuuggcaggccagggguucgccuuaaagaacguguuugacaugagaauccaaugcccccacuccgucaauuucggagagaccucuguuucagguuacacagaacugccuccacuaagucuccaggaggcggaacagcuggugccggagagcuccuguaacauggauaaucaucagucucuuucgacuauuaacaaacugacgaagguaauauggaggaaaaaggcuaaucaagaaucagccagccagaacaguuuugagguggucgaguccgaaaucucuuucaaaggcuugugcaugcucaagcaccggaugguggaggaaagcuaucgcaaucgacguuccguuauuuguuacgaccuggcaugcaacucaaccuuuuguaagcccacaguguauaugaucgucccuauucaugccugcaauaugaugaaaaguugucugaucgggcucggaccauacagaauacaggugguauaugagaggacuuacugcaccacaggcaucuuaaccgaggguaaguguuucguucccgauaaagcuguggucagcgcacugaagcgggggauguaugccauugcuucuaucgaaacuauuugcuuuuucauccaccagaaaggaaacacauacaagauagugaccgccauuacguccgcgaugggcucaaaguguaauaacacugacaccaaagugcaaggcuacuauaucugcauuaucgggggaaauagcgcaccugucuacgccccagcuggugaggauuuucgcgccauggaaguuuucaguggcaucauuacaucuccccauggggaggaccacgaucuuccuggagaagagauagcaacuuaucagaucuccggccagauugaggcuaagaucccacacaccgugagcucgaaaaacuugaagcugacagccuuugcggguauaccgucuuacuccucaaccaguauucuagccgcaagcgaagacgggagauucaucuuuucccccggacucuucccuaaucugaaccagucuguaugcgauaacaaugcuuugccacugaucuggaggggcuugauugaccucacgggcuauuacgaggccgugcaucccuguaacgucuucugcgugcugagcgggccuggagcuucaugugaagccuuuagugaggguggcaucuucaauauuacuuccccaaugugcuuaguuagcaaacaaaaccgguuucgcgcagccgaacagcagauaucuuucgugugucaacgagucgauauggacaucauuguguauugcaaugggcagaagaaaacaauccugaccaagacucucguaaucggacaguguauuuacacaauaaccucacuuuuuagucuguugcccggcguugcucacagcaucgcgauugagcuaugcgugccggguuuccaugggugggcaacggccgcucugcucaucaccuuuuguuucggcuggguccugauuccugccugcacacuugcaauccuguuggugcucaaguuuuucgccaacauacugcacacuuccaaucaggagaacagauuuaaagcuaucuuaaggaagauuaaagaagaguucgaaaagaccaaaggaucuauggucugugagaucugcaaguacgaaugcgagacacugaaggagcuaaaagcccacaaucucucgugugugcaaggcgaaugccccuauuguuuuacucauugcgagccaaccgaaacagcaauucaggcgcacuacaagguuugucaggcuacccaucgguuccgugaggaucugaaaaagacugugacgccucagaacaucgggcccggaugcuaucgcacacuuaauuuguucagauacaaauccagguguuauauacugaccauguggacucuccugcuuauuaucgagagcauucugugggccgcaucagccgcugaaaucccauugguaccccucuggaccgacaacgcccacggugucggcagugugccuaugcauacagaccuggaguuagauuuuucucugccaagcuccucaaaguacaccuauaagcggcaccuaacuaauccgguuaacgaccaacagagcgugucucuccacauagaaaucgagucccaggggauuggagcagauguccaucaccugggccauugguacgacgcucgacuuaauuugaaaacaaguuuccacugcuacggugccuguacgaaguaucaguaccccuggcacaccgcgaaaugccauuuugaaaaggauuaugaguacgagaacagcugggccuguaacccuccagacugccccggggugggcacuggaugcacagcuuguggccuguaucucgaucaacugaaaccuguagggaccgcauucaagaucauuucugugcgcuacuccagaaagguuugcguccaguuuggagaagaguauuuauguaaaacaaucgacaugaaugauugcuucgugacuaggcacgccaagauauguauuaucgguaccgugucaaaauuuagucagggcgacacgcugcuuuucuuggggccaauggaaggaggcgguaucauuuuuaagcauuggugcaccagcacaugucacuucggggaucccggcgacgucaugggaccgaaagacaagccuuuuaucugcccagaguuccccggccaguuucggaaaaaguguaacuucgcuacuaccccuguuugcgaauacgaugggaauauuauaucgggauacaagaaagugcucgccacaaucgacuccuuccaaucuuuuaacacuagcaauauucauuucaccgaugagcgcaucgaguggagagaccccgauggcaugcugagggaccacauuaacaucgugauaucaaaggauaucgacuuugaaaaucuagcagagaacccauguaaaguaggucugcaggcggccaauauugaaggggcuuggggaaguggcgucgguuucacgcucacaugccaggugucccugaccgagugcccuacuuuucuuacaucuaucaaggccugugauauggcaauuugcuauggcgcugaaagcguuaccuugucccgugggcaaaacacugugaaaaucaccggaaagggcgggcacucaggaagcaguuucaaguguugccauggcaaagaguguucuuccacaggucugcaggccagcgcaccccacuuagacaaggucaaugggauaucggagcucgaaaacgagaaaguguacgaugacggagccccagaaugcggcauuacguguugguuuaagaaaucaggugaguggguuaugggcaucaucaaugggaacugggugguacugauuguccuuugcgugcugcuucucuucucucugauacuacugaguauccucuguccggugcggaagcauaagaaauccuga
